(12) United States Patent
Berry et al.

(10) Patent No.: US 9,598,474 B2
(45) Date of Patent: *Mar. 21, 2017

(54) NUTRITIVE FRAGMENTS, PROTEINS AND METHODS

(71) Applicant: Pronutria, Inc., Cambridge, MA (US)

(72) Inventors: David Arthur Berry, Brookline, MA (US); Brett Adam Boghigian, Boston, MA (US); Nathaniel W. Silver, Cambridge, MA (US); Geoffrey von Maltzahn, Boston, MA (US); Rajeev Chillakuru, Cambridge, MA (US); Michael Hamill, Wellesley, MA (US); John F. Kramarczyk, Somerville, MA (US)

(73) Assignee: Axcella Health, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/374,127

(22) PCT Filed: Mar. 15, 2013

(86) PCT No.: PCT/US2013/032218
§ 371 (c)(1),
(2) Date: Jul. 23, 2014

(87) PCT Pub. No.: WO2013/148330
PCT Pub. Date: Oct. 3, 2013

(65) Prior Publication Data
US 2015/0011482 A1  Jan. 8, 2015

Related U.S. Application Data

(60) Provisional application No. 61/615,819, filed on Mar. 26, 2012.

(51) Int. Cl.
*A23J 3/04* (2006.01)
*C07K 14/435* (2006.01)
*A23L 1/305* (2006.01)
*A61K 38/17* (2006.01)

(52) U.S. Cl.
CPC ............ *C07K 14/435* (2013.01); *A23L 1/305* (2013.01); *A23L 1/3053* (2013.01); *A23V 2002/00* (2013.01); *A61K 38/1709* (2013.01)

(58) Field of Classification Search
None
See application file for complete search history.

(56) References Cited

U.S. PATENT DOCUMENTS

| 3,870,801 | A | 3/1975 | Tombs |
| 4,016,147 | A | 4/1977 | Fujimaki et al. |
| 4,601,980 | A | 7/1986 | Goededel et al. |
| 4,687,782 | A | 8/1987 | Brantman |
| 5,736,187 | A | 4/1998 | Tesmer et al. |
| 5,866,338 | A | 2/1999 | Hartwell et al. |
| 6,004,930 | A | 12/1999 | Hainline |
| 6,291,245 | B1 | 9/2001 | Kopetzki et al. |
| 6,361,966 | B1 | 3/2002 | Walker et al. |
| 6,495,344 | B1 | 12/2002 | Carr |
| 6,630,320 | B1 | 10/2003 | Davis et al. |
| 7,211,431 | B2 | 5/2007 | Rao et al. |
| 7,214,786 | B2 | 5/2007 | Kovalic |
| 7,252,972 | B2 | 8/2007 | Kikuchi et al. |

(Continued)

FOREIGN PATENT DOCUMENTS

CN  101886107 A  11/2010
EP  0347890 B1  3/1993

(Continued)

OTHER PUBLICATIONS

Takio et. al. Proc. Nati. Acad. Sci. USA, vol. 84, pp. 4851-4855, Jul. 1987.*
Conti et al. J. Nutr. Biochem. 11:332-337, 2000.*
International Search Report and Written Opinion, PCT/US2013/032218, International Filing Date Mar. 15, 2013; 12 pages.
Aalberse, R. C., "Structural biology of allergens", J. Allergy Clin. Immunol. 106, 228-238 (2000).
Abou-Samra, R. et al., "Effect of different protein sources on satiation and short-term satiety when consumed as a starter", Nutr J. 10:139 (Dec. 23, 2011).
Acheson, K. et al., "Protein choices targeting thermogenesis and metabolism", Am J Clin Nutr 93:525-34 (2011).
Akhavan, T. et al., "Effect of premeal consumption of whey protein and its hydrolysate on food intake and postmeal glycemia and insulin responses in young adults", Am J Clin Nutr. 91(4):966-75 (Apr. 2010) (Epub Feb. 17, 2010).
Alfenas, R. et al., "Effects of protein quality on appetite and energy metabolism in normal weight subjects", Arq Bras Endocrinol Metabol. 54 (1): 45-51; (2010).
Austin, B. P. et al., "Hexahistidine-tagged maltose-binding protein as a fusion partner for the production of soluble recombinant proteins in *Escherichia coli*", Methods Mol. Biol. 498:157-72 (2009).

(Continued)

*Primary Examiner* — Jeanette Lieb
(74) *Attorney, Agent, or Firm* — Fenwick & West LLP

(57) ABSTRACT

Nutritive proteins are provided. In some embodiments the nutritive proteins comprise a first polypeptide sequence comprising a fragment of a naturally-occurring nutritive protein. In some embodiments the fragment comprises at least one of a) an enhanced ratio of branch chain amino acid residues to total amino acid residues present in the nutritive protein; b) an enhanced ratio of leucine residues to total amino acid residues present in the nutritive protein; and c) an enhanced ratio of essential amino acid residues to total amino acid residues present in the nutritive protein. In some embodiments, the fragment comprises at least one of a) a ratio of branch chain amino acid residues to total amino acid residues present in the nutritive protein; b) a ratio of leucine residues to total amino acid residues present in the nutritive protein; and c) a ratio of essential amino acid residues to total amino acid residues present in the nutritive protein, that is equal to or greater than the corresponding ratio present in a benchmark protein such as whey, egg or soy protein. Also provided are nucleic acids encoding the proteins, recombinant microorganisms that make the proteins, methods of making the proteins using recombinant microorganisms, compositions that comprise the proteins, and methods of using the proteins, among other things.

20 Claims, 1 Drawing Sheet

(56) References Cited

U.S. PATENT DOCUMENTS

| | | |
|---|---|---|
| 7,314,974 B2 | 1/2008 | Cao et al. |
| 7,790,688 B2 | 9/2010 | Wolfe et al. |
| 8,071,122 B2 | 12/2011 | Yamka et al. |
| 8,329,646 B2 | 12/2012 | Tisdale et al. |
| 8,343,747 B2 | 1/2013 | Burke et al. |
| 8,409,840 B2 | 4/2013 | Muller et al. |
| 8,426,184 B2 | 4/2013 | Blum et al. |
| 8,486,888 B2 | 7/2013 | Greenberg |
| 8,546,118 B2 | 10/2013 | Weiner et al. |
| 8,618,047 B2 | 12/2013 | Hofman et al. |
| 8,735,107 B2 | 5/2014 | Weiner et al. |
| 8,809,259 B2 | 8/2014 | Berry et al. |
| 8,815,806 B2 | 8/2014 | Aluko et al. |
| 8,822,412 B2 | 9/2014 | Berry et al. |
| 8,877,281 B2 | 11/2014 | Segall et al. |
| 9,364,463 B2 | 6/2016 | Ferrando et al. |
| 2004/0071825 A1 | 4/2004 | Lockwood |
| 2004/0123343 A1 | 6/2004 | La Rosa et al. |
| 2004/0266689 A1 | 12/2004 | McMichael et al. |
| 2005/0010973 A1 | 1/2005 | Rao et al. |
| 2006/0150283 A1 | 7/2006 | Alexandrov et al. |
| 2006/0159724 A1 | 7/2006 | Bell |
| 2007/0264688 A1 | 11/2007 | Venter |
| 2008/0032000 A1 | 2/2008 | Schnorr et al. |
| 2008/0206430 A1 | 8/2008 | Avila |
| 2008/0268038 A1 | 10/2008 | Wolfe |
| 2008/0317725 A1 | 12/2008 | Baum |
| 2009/0181903 A1 | 7/2009 | Wolfe et al. |
| 2009/0197820 A1 | 8/2009 | Wolfe et al. |
| 2009/0203606 A1 | 8/2009 | Wolfe et al. |
| 2009/0252684 A1 | 10/2009 | Wolfe et al. |
| 2009/0304901 A1 | 12/2009 | Bobzin et al. |
| 2010/0055246 A1 | 3/2010 | Ahn |
| 2010/0179089 A1 | 7/2010 | Deutz et al. |
| 2010/0189864 A1 | 7/2010 | Marsland |
| 2010/0189865 A1 | 7/2010 | Sweet |
| 2010/0267831 A1 | 10/2010 | Kobayashi et al. |
| 2010/0286023 A1 | 11/2010 | Wolfe et al. |
| 2010/0317597 A1* | 12/2010 | Ney ............ A61K 38/018 514/20.9 |
| 2010/0330250 A1 | 12/2010 | Segall et al. |
| 2011/0183052 A1 | 7/2011 | Sherwood et al. |
| 2011/0250310 A1 | 10/2011 | Mateus et al. |
| 2011/0319596 A1 | 12/2011 | De La Torre-Montemayor |
| 2012/0046449 A1 | 2/2012 | Green et al. |
| 2012/0178672 A1 | 7/2012 | Wolfe et al. |
| 2013/0090297 A1 | 4/2013 | Troup et al. |
| 2013/0296231 A1 | 11/2013 | Berry et al. |
| 2014/0342978 A1 | 11/2014 | Berry et al. |
| 2014/0343148 A1 | 11/2014 | Kohsaka et al. |
| 2015/0080296 A1 | 3/2015 | Silver et al. |

FOREIGN PATENT DOCUMENTS

| | | |
|---|---|---|
| EP | 1552753 B1 | 7/2005 |
| EP | 1455603 B1 | 10/2006 |
| KR | 10-2010-0057630 A | 5/2010 |
| KR | 2010-005760 A | 5/2010 |
| WO | WO 02/087562 A1 | 11/2002 |
| WO | WO 2004/052295 A2 | 6/2004 |
| WO | WO 2004/058988 A2 | 7/2004 |
| WO | WO 2006/047308 A2 | 5/2006 |
| WO | WO 2007/023172 A2 | 3/2007 |
| WO | WO 2007/053390 A2 | 5/2007 |
| WO | WO 2010/043415 A2 | 4/2010 |
| WO | WO 2010/126353 A1 | 11/2010 |
| WO | WO 2010-126353 A1 | 11/2010 |
| WO | WO 2010/126362 A1 | 11/2010 |
| WO | WO 2010/144821 A1 | 12/2010 |
| WO | WO 2011/027188 A1 | 3/2011 |
| WO | WO 2011/078677 A2 | 6/2011 |
| WO | WO 2011/084978 A1 | 7/2011 |
| WO | WO 2011/119023 A1 | 9/2011 |
| WO | WO 2011/119033 A1 | 9/2011 |
| WO | WO 2012/005568 A1 | 1/2012 |
| WO | WO 2012/006074 A1 | 1/2012 |
| WO | WO 2013/148330 A1 | 10/2013 |
| WO | WO 2013/148331 A1 | 10/2013 |
| WO | WO 2014/134225 A2 | 9/2014 |

OTHER PUBLICATIONS

Avruch, J. et al., "Amino acid regulation of TOR complex 1", Am J Physiol Endocrinol Metab. 296:E592-602. (2009).

Bai, J. et al., "A gene optimization strategy that enhances production of fully functional P-Glycoprotein in Pichia pastoris", PLoS One 6(8):e22577 (2011).

Belza, A. et al., "The beta-adrenergic antagonist propranolol partly abolishes thermogenic response to bioactive food ingredients", Metabolism. 58 (8):1137-44 (2009).

Borsheim, E. et al., "Effect of amino acid supplementation on muscle mass, strength and physical function in elderly", Clin Nutr. 27:189-195 (2008).

Borsheim, E. et al., "Essential amino acids and muscle protein recovery from resistance exercise", Am J Physiol Endocrinol Metab. 283: E648-E657 (2002).

Bossios, A. et al., "Effect of simulated gastro-duodenal digestion on the allergenic reactivity of beta-lactoglobulin", Clin Transl Allergy. 1:6. (2011).

Breen, L., Churchward-Venne T a., "Leucine: a nutrient "trigger" for muscle anabolism, but what more?" J Physiol. 590:2065-6. (2012).

Breen, L., Phillips SM., "Skeletal muscle protein metabolism in the elderly: Interventions to counteract the "anabolic resistance" of ageing", Nutr Metab. Lond. 8:68. (2011).

Brockerhoff, S.E. et al., "Structural Analysis of Wild-Type and Mutant Yeast Calmodulins by Limited Proteolysis and Electrospray Ionization Mass Spectrometry," Protein Science, 1992, pp. 504-516, vol. I.

Butts, C. et al., "In vitro determination of dietary protein and amino acid digestibility for humans", Br J Nutr;108 Suppl :S282-7. (2012).

Cheng, C.-H. et al., "Protein Solubility and Differential Proteomic Profiling of Recombinant *Escherichia coli* Overexpressing Double-Tagged Fusion Proteins," Microbial Cell Factories, Aug. 28, 2010, pp. 63-75, vol. 9.

Conti, A. et al., "Identification of the Human β-Casein C-Terminal Fragments That Specifically Bind to Purified Antibodies to Bovine β-Lactoglobulin," J. Nutr. Biochem., 2000, pp. 332-337, vol. 11.

Dauncey, M., Bingham S., "Dependence of 24 h energy expenditure in man on composition of the nutrient intake", Br J Nutr. 50:1-13 (1983).

De Baulny, H.O. et al., "Management of Phenylketonuria and Hyper-Phenylalaninemia," The Journal of Nutrition, Jun. 2007, pp. 1561S-1563S, vol. 137.

Delaney, B. et al., "Evaluation of protein safety in the context of agricultural biotechnology." Food. Chem. Toxicol. 46: S71-S97 (2008).

Deutz, N.E.P. et al., "Muscle protein synthesis in cancer patients can be stimulated with a specially formulated medical food", Clin Nutr. 30:759-68. (2011).

Dreyer, et al., "Leucine-enriched essential amino acid and carbohydrate ingestion following resistance exercise enhances mTOR signaling and protein synthesis in human muscle", Am. J. Physiol. Endocrinol. Metab. 294(2):E392-E400 (2008).

Dulloo, A., "The search for compounds that stimulate thermogenesis in obesity management: from pharmaceuticals to functional food ingredients." Obes Rev. 12:866-83 (2011).

Eastoe, J. E., "The Amino Acid Composition of Mammalian Collagen and Gelatin", Biochem. J., vol. 61, pp. 589-600 (1955).

Elango, R. et al., "Available versus digestible amino acids—new stable isotope methods", Br J Nutr.108 Suppl:S306-14. (2012).

Esmarck, B. et al., "Timing of postexercise protein intake is important for muscle hypertrophy with resistance training in elderly humans", J Physiol. 535: 301-311. (2001).

Fernstrom, J.D., Wolfe R.R., "Introduction to Symposium on Branched-Chain Amino Acids in Exercise", J Nutr.136:524S. (2006).

(56) References Cited

OTHER PUBLICATIONS

Ferrando, A. et al., "EAA supplementation to increase nitrogen intake improves muscle function during bed rest in the elderly", Clin Nutr. 29:18-23. (2010).
Fromentin, G. et al., "Peripheral and central mechanisms involved in the control of food intake by dietary amino acids and proteins", Nutr Res Rev. 25: 29-39. (2012).
Fujita, et al., "Nutrient signaling in the regulation of human muscle protein synthesis", J. Physio. 582.2:813-23 (2007).
Golovanov, A.P. et al., "A Simple Method for Improving Protein Solubility and Long-Term Stability," Journal of the American Chemical Society, Jul. 28, 2004, pp. 8933-8939, vol. 126, No. 29.
Goodman, R. E. et al., "Allergenicity assessment of genetically modified crops—what makes sense?" Nature Biotechnology. pp. 73-81 (2008).
Gran, P., Cameron-Smith D., "The actions of exogenous leucine on mTOR signalling and amino acid transporters in human myotubes", BMC Physiol. 11:10. (2011).
Hall, W. L. et al., "Casein and whey exert different effects on plasma amino acid profiles, gastrointestinal hormone secretion and appetite", Br J Nutr. 89(2):239-48 (Feb. 2003).
Haran, P. H. et al., "Role and potential mechanisms of anabolic resistance in sarcopenia", J Cachexia Sarcopenia Muscle (2012).
Hayakawa, S. et al., "Relationships of Hydrophobicity and Net Charge to the Solubility of Milk and Soy Proteins," Journal of Food Science, Mar. 1985, pp. 486-491, vol. 50, No. 2.
Hefford, M.A., "Engineering Nutritious Proteins," Biotechnology and Genetic Engineering Reviews, Apr. 1997, pp. 191-210, vol. 14, No. 1.
Herman, R a. et al., "Digestion Assays in Allergenicity Assessment of Transgenic Proteins", Environ Health Perspect. 114:1154-7. (2006).
Holt, C. et al., "Some physico-chemical properties of nine commercial or semi-commercial whey protein concentrates, isolates and fractions", Int J Food Sci Technol. 34:587-601. (1999).
Holt, C. et al., "Apparent chemical composition of nine commercial or semi-commercial whey protein concentrates, isolates and fractions", Int J Food Sci Technol. 34:543-556. (1999).
Jenkins, J. A. et al., "Evolutionary distance from human homologs reflects allergenicity of animal food proteins", J. Allergy Clin Immunol. 120: 1399-1405 (2007).
Kalogeropoulou, D. et al., "Leucine, when ingested with glucose, synergistically stimulates insulin secretion and lowers blood glucose", Metabolism. 57:1747-52. (2008).
Katsanos, C. S. et al., "A high proportion of leucine is required for optimal stimulation of the rate of muscle protein synthesis by essential amino acids in the elderly", Am J Physiol Metab. 291:E381-7. (2006).
Kong, F., Singh R. P., "Disintegration of Solid Foods in Human Stomach," Journal of Food Science. pp. 67-80 (2008).
Koopman, et al., "Co-ingestion of leucine with protein does not further augment post-exercise muscle protein synthesis rates in elderly men", Br. J. Nutr. 99:571-80 (2008).
Koopman, et al., "Combined ingestion of protein and free leucine with carbohydrate increases postexercise muscle protein synthesis in vivo in male subjects", Am. J. Physiol. Endocrinol. Metab. 288:E645-643 (2005).
Kopf-Bolanz, K. A. et al., "Validation of an In Vitro Digestive System for Studying Macronutrient Decomposition" in 245-50. (2012).
Lands, L.C. et al.,"Effect of Supplementation with a Cysteine Donor on Muscular Performance," Journal of Applied Physiology, Oct. 1999, pp. 1381-1385, vol. 87, No. 4.
Lorenzen, J, et al. "The effect of milk proteins on appetite regulation and diet-induced thermogenesis", J Clin Nutr. 66 (5): 622-7. (2012).
Macauley-Patrick, S. et al., "Heterologous protein production using the Pichia pastoris expression system", Yeast. 22:249-70. (2005).
Macleod, E.L. et al., "Nutritional Management of Phenylketonuria," Annales Nestle, Jun. 2010, pp. 58-69, vol. 68, No. 2.

Malakhov, M. P.et al., "SUMO fusions and SUMO-specific protease for efficient expression and purification of proteins", J Struct Funct Genomics. 5(1-2):75-86 (2004).
Manders, et al., "Co-ingestion of a protein hydrolysate and amino acid mixture with carbohydrate improves plasma glucose disposal in patients with type 2 diabetes", Am. J. Clin. Nutr. 82(1):76-83 (2005).
Martos, G. et al., "Egg White Ovalbumin Digestion Mimicking Physiological Conditions." Journal of Agricultural and food chemistry. pp. 5640-5648 (2010).
Mikkelsen, P. et al., "Effect of fat-reduced diets on 24 h energy expenditure: comparisons between animal protein, vegetable protein and carbohydrate", Am J Clin Nutr. 72:1135-41 (2000).
Moore, D. et al., "Ingested protein dose response of muscle and albumin protein synthesis after resistance exercise in young men", Am J Clin Nutr. 89: 161-8. (2009).
Moreno, F. J. et al., "Phospholipid interactions protect the milk allergen a-Lactalbumin from proteolysis during in vitro digestion", Journal of agricultural and food chemistry. pp. 9810-9816 (2005).
Moreno, et al., "Stability of the major allergen Brazil nut 2S albumin (Ber e 1) to physiologically relevant in vitro gastrointestinal digestion", FEBS Journal. pp. 341-352. (2005).
Nicastro, H. et al., "An overview of the therapeutic effects of leucine supplementation on skeletal muscle under atrophic conditions", Amino Acids;40:287-300. (2011).
Norton, L. E. et al., "Leucine content of dietary proteins is a determinant of postprandial skeletal muscle protein synthesis in adult rats", Nutr Metab (Lond) 9:67. (2012).
Op Den Kamp, C. et al., "Muscle atrophy in cachexia: can dietary protein tip the balance?" Current Opinion in Clinical Nutrition and Metabolic Care. 12:611-616 (2009).
Paddon-Jones, et al., "Essential amino acid and carbohydrate supplementation ameliorates muscle protein loss in humans during 28 days bed rest", J Clin Endocrinol Metab; 89:4351-435 (2004).
Paddon-Jones, D. et al., "Nutritional Consequences of Critical Illness Myopathies Amino Acid Supplementation for Reversing Bed Rest and Steroid", J Nutr. 135:1809-12. (2005).
Panavas, T. et al., "SUMO fusion technology for enhanced protein production in prokaryotic and eukaryotic expression systems", Methods Mol Biol. 497:303-17. (2009).
Pasiakos, S. M., "Exercise and amino acid anabolic cell signaling and the regulation of skeletal muscle mass", Nutrients. 4:740-58. (2012).
PCT International Search Report, PCT Application No. PCT/US13/71091, May 2, 2014, 25 pages.
PCT International Search Report and Written Opinion, PCT Application No. PCT/US2013/032212, Jun. 28, 2013, 15 pages.
PCT International Search Report, PCT Application No. PCT/US2013/032180, Jun. 28, 2013, 14 pages.
PCT International Search Report, PCT Application No. PCT/US2013/032232, Jun. 26, 2013, 13 pages.
PCT International Search Report and Written Opinion, PCT Application No. PCT/US2013/032225, Jun. 26, 2013, 15 pages.
PCT International Search Report and Written Opinion, PCT Application No. PCT/US2013/032218, Jul. 22, 2013, 12 pages.
PCT International Search Report and Written Opinion, PCT Application No. PCT/US2013/032206, Jun. 26, 2013, 12 pages.
Poon, R. T-P. et al., "Long-term oral branched chain amino acids in patients undergoing chemoembolization for hepatocellular carcinoma: a randomized trial", Aliment Pharmacol Ther. 19:779-788. (2004).
Porro, D. et al., "Production of recombinant proteins and metabolites in yeasts: when are these systems better than bacterial production systems?" Appl Microbiol Biotechnol. 89:939-48. (2011).
Punt, P. J. et al., "Filamentous fungi as cell factories for heterologous protein production", Trends Biotechnol. 20:200-6. (2002).
Reddy, I. M. et al., "Structural and conformational Basis of the Resistance of b-Lactoglobulin to Peptic and Chymotryptic Digestion", J. Agric. Food Chem. vol. 36. pp. 737-741 (1988).
Saitoh, H. et al., "Strategies for the expression of SUMO-modified target proteins in *Escherichia coli*", Methods Mol. Biol. 497:211-21. (2009).

(56) References Cited

OTHER PUBLICATIONS

Sitkoff, D. et al., "Accurate Calculation of Hydration Free Energies Using Macroscopic Solvent Models", J. Phys. Chem. 98 (1994).
Sun, X., Zemel M. B., "Leucine and calcium regulate fat metabolism and energy partitioning in murine adipocytes and muscle cells", Lipids. 42:297-305. (2007).
Takio, K. et al., "Amino Acid Sequence of the β Subunit of Bovine Lung Casein Kinase II," Proc. Natl. Acad. Sci. USA, Jul. 1987, pp. 4851-4855, vol. 84.
Tang, J. E., Phillips S. M., "Maximizing muscle protein anabolism: the role of protein quality", Curr Opin Clin Nutr Metab Care. 12:66-71. (2009).
Tappy, L. et al., "Thermic effect of infused amino acids in healthy humans and in subjects with insulin resistance", Am J Clin Nutr. 57 (6): 912-6. (1993).
Tayek, J. A. et al., "Improved protein kinetics and albumin synthesis by branched chain amino acid-enriched total parenteral nutrition in cancer cachexia", Cancer. 58:147-57 (1986).
Thomas, K. et al., "Evaluating the effect of food processing on the potential human allergenicity of novel proteins: international workshop report.", Food Chem Toxicol. 45:1116-22. (2007).
Tipton, K. D. et al., "Stimulation of muscle anabolism by resistance exercise and ingestion of leucine plus protein", Appl Physiol Nutr Metab. 34:151-61. (2009).
Van Dijl, J. M., Hecker M., "Bacillus subtilis: from soil bacterium to super-secreting cell factory", Microb Cell Fact.12:3. (2013).
Veldhorst, M. A., "Dose-dependent satiating effect of whey relative to casein or soy", Physiol Behav. 96(4-5):675-82. (Mar. 23, 2009).
Volpi, E. et al., "Essential amino acids are primarily responsible for the amino acid stimulation of muscle protein anabolism in healthy elderly adults", Am J Clin Nutr. 78:250-8. (2003).
Wolfe, R. R., "Branched-Chain Amino Acids in Exercise Skeletal Muscle Protein Metabolism and Resistance Exercise", J Nutr. 525-8. (2006).
Wolfe, R. R., "Regulation of Muscle Protein by Amino Acids", J Nutr. 132:3219S-3224S. (2002).
Xi, P. et al, "Regulation of protein metabolism by glutamine: implications for nutrition and health", Front Biosci. 16:578-97. (2011).
US Pre-Interview First Office Action, U.S. Appl. No. 13/836,855, Apr. 10, 2014, 5 pages.
United States Notice of Allowance with Applicant Initiated Interview Summary U.S. Appl. No. 13/836,855, May 23, 2014, 19 pages.
GenBank Accession No. P13915 (Jan. 1, 1990).
GenBank Accession No. Q39817 (Jul. 15, 1998).
GenBank Accession No. O82709 (Dec. 1, 2000).
GenBank Accession No. P30236 (Apr. 1, 1993).
GenBank Accession No. Q29092 (Dec. 15, 1998).
GenBank Accession No. P19244 (Nov. 1, 1990).
GenBank Accession No. Q9TV61 (Feb. 6, 2007).
GenBank Accession No. Q9TV63 (Feb. 6, 2007).
GenBank Accession No. P15590 (Apr. 1, 1990).
GenBank Accession No. Q9TV62 (Feb. 6, 2007).
GenBank Accession No. Q9SP22 (Dec. 1, 2000).
GenBank Accession No. Q9SLY8 (Dec. 1, 2000).
GenBank Accession No. P86412 (Aug. 10, 2010).
GenBank Accession No. Q6YNX6 (Oct. 25, 2005).
GenBank Accession No. Q6YNX6 (Dec. 15, 1998).
GenBank Accession No. Q08275 (Feb. 1, 1995).
GenBank Accession No. P02547 (Jul. 21, 1986).
GenBank Accession No. Q6Z6L5 (Nov. 3, 2009).
GenBank Accession No. Q0JNS6 (Jul. 10, 2007).
GenBank Accession No. Q0DJV6 (Jun. 10, 2008).
GenBank Accession No. Q01UU4 (Jun. 10, 2008).
GenBank Accession No. P62163 (Jun. 21, 2004).
GenBank Accession No. P04353 (Mar. 20, 1987).
GenBank Accession No. A2WN93 (Jul. 10, 2007).
GenBank Accession No. A2WNH1 (Jul. 10, 2007).
GenBank Accession No. P93087 (Jul. 15, 1998).
GenBank Accession No. Q7DMN9 (Nov. 23, 2004).
GenBank Accession No. P84339 (Feb. 1, 2005).
GenBank Accession No. P24632 (Mar. 1, 1992).
GenBank Accession No. Q5ZCK5 (Jun. 10, 2008).
GenBank Accession No. Q6ES52 (Jun. 15, 2010).
GenBank Accession No. P29269 (Dec. 1, 1992).
GenBank Accession No. P41040 (Feb. 1, 1995).
GenBank Accession No. P24631 (Mar. 1, 1992).
GenBank Accession No. Q6F332 (Jul. 25, 2006).
GenBank Accession No. Q0JNL7 (Jul. 10, 2007).
GenBank Accession No. Q01QB6 (Jun. 10, 2008).
GenBank Accession No. A2Y609 (Jun. 10, 2008).
GenBank Accession No. Q40642 (Jun. 10, 2008).
GenBank Accession No. P04464 (Aug. 13, 1987).
GenBank Accession No. P48976 (Feb. 1, 1996).
GenBank Accession No. P27161 (Aug. 1, 1992).
GenBank Accession No. Q8S1Y9 (Jun. 10, 2008).
GenBank Accession No. P13868 (Jan. 1, 1990).
GenBank Accession No. P10246 (Jul. 1, 1989).
GenBank Accession No. P46254 (Nov. 1, 1995).
GenBank Accession No. Q84MN0 (Jun. 10, 2008).
GenBank Accession No. Q2R1Z5 (Jun. 10, 2008).
GenBank Accession No. P02540 (Jul. 21, 1986).
GenBank Accession No. P21753 (May 1, 1991).
GenBank Accession No. Q75ZZ6 (May 24, 2005).
GenBank Accession No. Q6DUB7 (Jan. 24, 2006).
GenBank Accession No. Q95274 (May 10, 2005).
GenBank Accession No. P58272 (Sep. 26, 2001).
GenBank Accession No. Q8S1Z1 (Apr. 4, 2003).
GenBank Accession No. B5X4E0 (Mar. 3, 2009).
GenBank Accession No. Q08655 (Oct. 1, 1994).
GenBank Accession No. Q10B98 (Sep. 2, 2008).
GenBank Accession No. Q6H7U2 (Sep. 2, 2008).
GenBank Accession No. P46618 (Nov. 1, 1995).
GenBank Accession No. P0C380 (May 29, 2007).
GenBank Accession No. P0C379 (May 29, 2007).
GenBank Accession No. P47815 (Feb. 1, 1996).
GenBank Accession No. Q29361 (Nov. 1, 1997).
GenBank Accession No. B5X186 (Mar. 3, 2009).
GenBank Accession No. P17703 (Aug. 1, 1990).
GenBank Accession No. B5DGI7 (Jul. 7, 2009).
GenBank Accession No. P37219 (Oct. 1, 1994).
GenBank Accession No. P0C470 (Jun. 12, 2007).
GenBank Accession No. P0C469 (Jun. 12, 2007).
GenBank Accession No. P69661 (Mar. 29, 2005).
GenBank Accession No. P42755 (Nov. 1, 1995).
GenBank Accession No. P12675 (Oct. 1, 1989).
GenBank Accession No. Q6ZK48 (May 29, 2007).
GenBank Accession No. A2YQU8 (May 29, 2007).
GenBank Accession No. Q0JHZ2 (Sep. 2, 2008).
GenBank Accession No. Q9M4U5 (Aug. 30, 2005).
GenBank Accession No. Q8LH03 (Mar. 2, 2010).
GenBank Accession No. P61268 (May 10, 2004).
GenBank Accession No. B5XCZ6 (Apr. 14, 2009).
GenBank Accession No. P56276 (Jul. 15, 1998).
GenBank Accession No. P14287 (Jan. 1, 1990).
GenBank Accession No. Q9MYT8 (Sep. 26, 2001).
GenBank Accession No. Q08000 (Nov. 1, 1995).
GenBank Accession No. Q29307 (Nov. 1, 1997).
GenBank Accession No. B5XGH3 (Mar. 24, 2009).
GenBank Accession No. Q9AS36 (May 15, 2007).
GenBank Accession No. O97965 (Sep. 27, 2004).
GenBank Accession No. Q2PMN9 (Oct. 31, 2006).
GenBank Accession No. Q6Q311 (Aug. 16, 2004).
GenBank Accession No. O04438 (Jan. 11, 2001).
GenBank Accession No. P22701 (Aug. 1, 1991).
GenBank Accession No. P83884 (May 10, 2004).
GenBank Accession No. P13618 (Jan. 1, 1990).
GenBank Accession No. Q65WT0 (Mar. 7, 2006).
GenBank Accession No. Q6K5K2 (Jun. 16, 2009).
GenBank Accession No. P12026 (Oct. 1, 1989).
GenBank Accession No. Q5KQI4 (Jun. 16, 2009).
GenBank Accession No. P04568 (Aug. 13, 1987).
GenBank Accession No. Q9XGX7 (Jan. 11, 2001).

(56) References Cited

OTHER PUBLICATIONS

GenBank Accession No. P46291 (Nov. 1, 1995).
GenBank Accession No. Q2MI43 (Oct. 31, 2006).
GenBank Accession No. Q69V36 (Jun. 16, 2009).
GenBank Accession No. P46517 (Nov. 1, 1995).
GenBank Accession No. Q9M314 (Aug. 29, 2001).
GenBank Accession No. P67985 (Oct. 11, 2004).
GenBank Accession No. P48504 (Feb. 1, 1996).
GenBank Accession No. Q94DE2 (Mar. 7, 2006).
GenBank Accession No. P12151 (Oct. 1, 1989).
GenBank Accession No. P0C474 (Jun. 12, 2007).
GenBank Accession No. A2XAM1 (May 20, 2008).
GenBank Accession No. P46520 (Nov. 1, 1995).
GenBank Accession No. P41101 (Feb. 1, 1995).
GenBank Accession No. Q64L94 (Nov. 9, 2004).
GenBank Accession No. Q10RE5 (Jun. 12, 2007).
GenBank Accession No. A2XCT8 (Jun. 12, 2007).
GenBank Accession No. Q7XNS7 (Feb. 7, 2006).
GenBank Accession No. P49120 (Feb. 1, 1996).
GenBank Accession No. Q41396 (Jul. 15, 1998).
GenBank Accession No. Q2PMR3 (Feb. 6, 2007).
GenBank Accession No. Q8L805 (Apr. 13, 2004).
GenBank Accession No. P28520 (Dec. 1, 1992).
GenBank Accession No. Q5JLY8 (Jul. 25, 2006).
GenBank Accession No. O18734 (Nov. 9, 2004).
GenBank Accession No. P49680 (Feb. 1, 1996).
GenBank Accession No. Q8LJS2 (Aug. 30, 2005).
GenBank Accession No. A7WLH8 (Dec. 4, 2007).
GenBank Accession No. Q2MJV9 (Nov. 28, 2006).
GenBank Accession No. A2XAM0 (Apr. 29, 2008).
GenBank Accession No. A1L4T4 (Jun. 12, 2007).
GenBank Accession No. A2Z7C4 (Jun. 12, 2007).
GenBank Accession No. P55844 (Nov. 1, 1997).
GenBank Accession No. A5YVD9 (Jun. 16, 2009).
GenBank Accession No. P0CE66 (Mar. 23, 2010).
GenBank Accession No. B7F6L8 (Mar. 23, 2010).
GenBank Accession No. Q2VEC4 (Jan. 24, 2006).
GenBank Accession No. Q943L2 (Jul. 10, 2007).
GenBank Accession No. A2WWU2 (Jul. 10, 2007).
GenBank Accession No. O65821 (Jun. 27, 2006).
GenBank Accession No. Q2QWE9 (May 20, 2008).
GenBank Accession No. Q9ZQW8 (Sep. 2, 2008).
GenBank Accession No. Q43694 (Nov. 2, 2001).
GenBank Accession No. A2ZIW7 (May 20, 2008).
GenBank Accession No. P60099 (Nov. 28, 2003).
GenBank Accession No. P60098 (Nov. 28, 2003).
GenBank Accession No. B5XG43 (Apr. 14, 2009).
GenBank Accession No. Q6ZBP3 (Jul. 10, 2007).
GenBank Accession No. A2YWI3 (Jul. 10, 2007).
GenBank Accession No. O49118 (May 30, 2000).
GenBank Accession No. P27723 (Aug. 1, 1992).
GenBank Accession No. P25461 (May 1, 1992).
GenBank Accession No. O04433 (Dec. 15, 1998).
GenBank Accession No. Q7XEJ5 (Feb. 7, 2006).
GenBank Accession No. P62272 (Jul. 5, 2004).
GenBank Accession No. A5JST6 (Feb. 26, 2008).
GenBank Accession No. P08698 (Jan. 1, 1988).
GenBank Accession No. A5A777 (Apr. 29, 2008).
GenBank Accession No. P6290 (Aug. 31, 2004).
GenBank Accession No. B5XG19 (Jun. 16, 2009).
GenBank Accession No. A1Y2B7 (May 20, 2008).
GenBank Accession No. Q2QLT8 (Feb. 20, 2007).
GenBank Accession No. P46605 (Nov. 1, 1995).
GenBank Accession No. Q8LNU5 (Jul. 25, 2006).
GenBank Accession No. O24473 (Jul. 15, 1998).
GenBank Accession No. P68211 (Oct. 25, 2004).
GenBank Accession No. Q05462 (Feb. 1, 1994).
GenBank Accession No. B5XBI1 (May 31, 2011).
GenBank Accession No. Q43216 (Jun. 13, 2006).
GenBank Accession No. O65818 (Jun. 27, 2006).
GenBank Accession No. B5SNZ6 (Mar. 24, 2009).
GenBank Accession No. P62262 (Jul. 5, 2004).
GenBank Accession No. Q8LJU5 (Jun. 21, 2004).
GenBank Accession No. Q5FZP5 (Oct. 14, 2008).
GenBank Accession No. Q0JGY1 (Sep. 11, 2007).
GenBank Accession No. Q29561 (Nov. 1, 1997).
GenBank Accession No. Q8H2P8 (Feb. 20, 2007).
GenBank Accession No. P55871 (Nov. 1, 1997).
GenBank Accession No. P02632 (Jul. 21, 1986).
GenBank Accession No. Q40703 (Aug. 30, 2005).
GenBank Accession No. B5X7E4 (May 31, 2011).
GenBank Accession No. Q941B1 (Aug. 21, 2007).
GenBank Accession No. Q6B7M7 (Oct. 11, 2004).
GenBank Accession No. P10668 (Jul. 1, 1989).
GenBank Accession No. P30755 (Jul. 1, 1993).
GenBank Accession No. A2WXX3 (Sep. 11, 2007).
GenBank Accession No. A1XQU5 (Jul. 24, 2007).
GenBank Accession No. Q08069 (Feb. 1, 1996).
GenBank Accession No. Q712U6 (May 16, 2006).
GenBank Accession No. P28807 (Dec. 1, 1992).
GenBank Accession No. P80220 (Oct. 1, 1993).
GenBank Accession No. P0C267 (Dec. 12, 2006).
GenBank Accession No. Q2M177 (Feb. 6, 2007).
GenBank Accession No. Q2VEF5 (Feb. 6, 2007).
GenBank Accession No. Q2PMR2 (Feb. 6, 2007).
GenBank Accession No. P28803 (Dec. 1, 1992).
GenBank Accession No. Q5G6V9 (Sep. 13, 2005).
GenBank Accession No. A5YVF1 (May 20, 2008).
GenBank Accession No. P27807 (Aug. 1, 1992).
GenBank Accession No. Q41418 (Nov. 1, 1997).
GenBank Accession No. Q95H63 (Aug. 30, 2002).
GenBank Accession No. P02754 (Jul. 21, 1986).
GenBank Accession No. P02662 (Jul. 21, 1986).
GenBank Accession No. P29290 (Dec. 1, 1992).
GenBank Accession No. Q5ZMN0 (Mar. 6, 2007).
GenBank Accession No. P35622 (Jun. 1, 1994).
GenBank Accession No. P02586 (Jul. 21, 1986).
GenBank Accession No. P63317 (Aug. 13, 1987).
GenBank Accession No. P63315 (Aug. 13, 1987).
GenBank Accession No. P60660 (Mar. 29, 2004).
GenBank Accession No. P02607 (Jul. 21, 1986).
GenBank Accession No. P02605 (Jul. 21, 1986).
GenBank Accession No. Q41784 (Dec. 1, 2000).
GenBank Accession No. P02587 (Jul. 21, 1986).
GenBank Accession No. Q03OJ7 (Feb. 5, 2008).
GenBank Accession No. Q8DHS3 (Nov. 21, 2003).
GenBank Accession No. Q5FJI8 (Feb. 26, 2008).
GenBank Accession No. Q9WZD0 (Aug. 2, 2002).
GenBank Accession No. Q74IP1 (Feb. 26, 2008).
GenBank Accession No. P06787 (Jan. 1, 1988).
GenBank Accession No. P52193 (Oct. 1, 1996).
GenBank Accession No. P67975 (Jul. 21, 1986).
"Amino Acid Calculation Results," Jan. 1, 1995 [Online] [Retrieved Nov. 30, 2015] Retrieved from the Internet<URL:http://Proteome.gs.washington.edu/cgi-bin/aa_calc.pl>.
Beauregard, M. et al., "Design, Expression, and Initial Characterization of MB1, a De Novo Protein Enriched in Essential Amino Acids," Biotechnology, Sep. 1995, pp. 974-981, vol. 13, 1995 Nature Publishing Group, http://wwww.nature, Jan. 1, 1995, [Online] [Retrieved on Nov. 30, 2015] Retrieved from the Internet<URL:http://www.nature.com/nbt/journal/v13/n9/pdf/nbt0995-974.pdf>.
Database Geneseq: "Rice Glutaredoxin Homolog/Ortholog Protein SEQ ID: 146," Oct. 18, 2007, Retrieved from EBI Accession No. GSP:AGV35765, Database Accession No. AGV35765.
Database Uniprot: "RecName: Full=Glycosylation-Dependent Cell Adhesion Molecule 1; Short=GlyCAM-1; AltName:Full=Lactophorin; AltName: Full=Proteose-Peptone Component 3; Short=PP3; AltName: Full=Whey Protein; Flags: Precursor;" Apr. 1, 1990, Retrieved from EBI Accession No. UNIPROT:P15522.
European Extended Search Report, European Application No. 13770012.6, Dec. 9, 2015, 8 pages.

(56) References Cited

OTHER PUBLICATIONS

European Extended Search Report, European Application No. 13768128.4, Dec. 16, 2015, 10 pages.
European Extended Search Report, European Application No. 13767346.3, Dec. 22, 2015, 10 pages.
European Extended Search Report, European Application No. 13768270.4, Jan. 12, 2016, 10 pages.
Fernholm, R. et al., "Amino Acid Profiles in Adults with Growth Hormone (GH) Deficiency Before and During GH Replacement Therapy," Growth Hormone & IGF Research, 2009, pp. 206-2011, vol. 19.
Fong, Y. et al., "Recombinant Growth Hormone Enhances Muscle Myosin Heavy-Chain mRNA Accumulation and Amino Acid Accrual in Humans," Proc. Natl. Acad. Sci., May 1989, pp. 3371-3374, vol. 86.
Goda, S.K. et al., "Recombinant Expression Analysis of Natural and Synthetic Bovine Alpha-Casein in *Escherichia coli*," Applied Microbiology and Biotechnology, Nov. 14, 2000, pp. 671-676, vol. 54, No. 5.
Humantrope® Package Leaflet: Information for the User, Jan. 2011, 2 pages, [Online] May be Retrieved at<URL:https://www.google.hu/search?q=humatrope+lilly&espv=2&biw=1920&bih=911&source=lnt&tbs=cdr%3A1%2Ccd_min%3A%2Ccd_max%3A2012.03.25&tbm=#>.
Kobayashi, H. et al., "Modulations of Muscle Protein Metabolism by Branched-Chain Amino Acids in Normal and Muscle-Atrophying Rats," The Journal of Nutrition, American Society for Nutrition, Jan. 1, 2006, pp. 234S-236S, vol. 136, No. 1.
Magne, H. et al., "Contrarily to Whey and High Protein Diets, Dietary Free Leucine Supplementation Cannot Reverse the Lack of Recovery of Muscle Mass After Prolonged Immobilization During Ageing," The Journal of Physiology, Feb. 2012, pp. 2035-2049, vol. 590.8.
Oser, B.L., "Assessment of the Nutritional Value of Novel Proteins," Journal of the American Oil Chemists Society (JAOCS), Nov. 1970, pp. 453-457, vol. 47, No. 11.
"Protropin Drug Description," RxList, Aug. 12, 2004, 2 pages, [Online] May be Retrieved at<URL:http://www.rxlist.com/protropin-drug.htm>.
Rieu, I. et al., "Increased Availability of Leucine with Leucine-Rich Whey Proteins Improves Postprandial Muscle Protein Synthesis in Aging Rats," Nutrition, 2007, pp. 323-331, vol. 23.
Russian Office Action, Russian Application No. 201414303(069502), Dec. 3, 2015, 14 pages.
Schein, C.H., "Solubility as a Function of Protein Structure and Solvent Components," Biotechnology, The International Monthly for Industrial Biology, Nature Publishing Group, Apr. 1990, pp. 308-317, vol. 8, No. 4.
Sindayikengera, S. et al., "Nutritional Evaluation of Caseins and Whey Proteins and Their Hydrolysates from Protamex," Journal of Zhejiang University Science B; an International Biomedicine & Biotechnology Journal, Feb. 2006, pp. 90-98, vol. 7, No. 2.
Singapore Office Action (including Search Report and Written Opinion), Singapore Application No. 11201405841R, Dec. 8, 2015, 22 pages.
United States Office Action, U.S. Appl. No. 14/337,563, Feb. 1, 2016, 13 pages.
Beg, O.U. et al., "Characterization of a Heterogeneous Camel Milk Whey Non-Casein Protein," FEBS Letters, Jun. 1987, pp. 270-274, vol. 216, No. 2.
Bolotin, A. et al., "The Complete Genome Sequence of the Lactic Acid Bacterium *Lactococcus lactis* ssp. *lactis* IL1403," Genome Research, 2001, pp. 731-753.
Broadbent, J.R. et al., "Contribution of Lactococcus lactis Cell Envelope Proteinase Specificity to Peptide Accumulation and Bitterness in Reduced-Fat Cheddar Cheese," Appled and Environmental Microbiology, Apr. 2002, pp. 1778-1785, vol. 68, No. 4.
Chinese First Office Action, Chinese Application No. 2013800273657, Feb. 24, 2016, 35 pages.
Grandjean, D. et al., "Essential Nutrition for Cats and Dogs," Waltham, 2009, pp. 1-64.
Ning, L. et al., "Biological Function of Branched Amino Acid in Sports Nutrition Supply and Its Application in Athletic Practice," Journal of Gansu Lianhe Univeristy (Natural Sicence Division), Jul. 10, 2009, pp. 117-119, vol. 23 (with English abstract).
Russian Office Action, Russian Application No. 2014143029/10(069500), Mar. 28, 2016, 7 pages.
Wang, X., "Effects of Essential Amino Acids in Food on Human Body Health," Food and Nutrition in China, Jul. 28, 2005, pp. 48-49, Iss. 7 (with concise explanation of relevance).
United States Pre-Interview First Office Action, U.S. Appl. No. 14/387,679, Feb. 24, 2016, 5 pages.
United States Pre-Interview First Office Action, U.S. Appl. No. 14/387,684, Mar. 10, 2016, 5 pages.
United States Office Action, U.S. Appl. No. 14/387,675, Apr. 7, 2016, 13 pages.
Australian First Examination Report, Australian Application No. 2013240183, May 16, 2016, 2 pages.
Pennings, B. et al., "Whey Protein Stimulated Postprandial Muscle Protein Accretion More Effectively Than Do Casein and Casein Hydrolysate in Older Men," Am. J. Clin. Nutr., Mar. 2, 2011, American Society for Nutrition, pp. 1-9.
United States Pre-Interview First Office Action, U.S. Appl. No. 14/387,677, May 2, 2016, 5 pages.
Barac, M. et al., "Profile and Functional Properties of Seed Proteins from Six Pea (*Pisum sativum*) Genotypes," Int. J. Mol. Sci., 2010, pp. 4973-4990, vol. 11.
Chinpongpanich, A. et al., "Biophysical Characterization of Calmodulin and Calmodulin-Like Proteins from Rice, *Oryza sativa* L.," Acta Biochim. Biophys. Sin., 2011, pp. 867-876, vol. 43.
Database EMBL Accession No. BX822075, *Arabidopsis thaliana* Full-Length cDNA Complete Sequence from Clone GSLTSIL9ZH07 of Silique of Strain Col-0 of *Arabidopsis thaliana* (Thale Cress), Retrieved from EBI Accession No. EMBL:BX822075, Feb. 6, 2004, 2 pages.
Database UniProt Accession No. 022287, "RecName: Full=Mannose-1-phosphate Guanylyltransferase 1; EC=2.7.7.13; AltName: Full=GDP-mannose Pyrophosphorylase 1; AltName: Full=Protein Embryo Defective 101; AltName: Full=Protein Hypersensitive to Ammonium Ion 1; AltName: Full=Protein Sensitive to 0," Retrieved from EBI Accession No. UNIPROT:022287, Sep. 21, 2011, 3 pages.
European Extended Search Report, European Application No. 13770153.8, Oct. 30, 2015, 11 pages.
Hughes, G.J. et al., "Protein Digestibility-Corrected Amino Acid Scores (PDCAAS) for Soy Protein Isolates and Concentrate: Criteria for Evaluation," Journal of Agricultural and Food Chemistry, Dec. 14, 2011, pp. 12707-12712, vol. 59, No. 23.
Israel Office Action, Israel Patent Application No. 234617, Oct. 22, 2015, 3 pages (with concise explanation of relevance).
Israel Office Action, Israel Patent Application No. 234621, Oct. 22, 2015, 3 pages (with concise explanation of relevance).
Lee, J., "Soy Protein Hydrolysate; Solubility, Thermal Stability, Bioactivity, and Sensory Acceptability in a Tea Beverage," Master's Thesis, University of Minnesota, Aug. 2011, 131 pages.
Sang, J. et al., "Cross-Talk Between Calcium-Calmodulin and Nitric Oxide in Abscisic Acid Signaling in Leaves of Maize Plants," Cell Research, 2008, pp. 577-588, vol. 18.
Schaafsma, G., "Criteria and Significance of Dietary Protein Sources in Humans and the Protein Digestibility-Corrected Amino Acid Score 1," J. Nutr., Jul. 31, 2000, pp. 1865S-1867S, [Online] [Retrieved on Oct. 15, 2015] Retrieved from the Internet<URL:http://jn.nutrition.org/content/130/7/1865S.full.pdf+html>.
Singapore Office Action, Singapore Application No. 11201405842P, Nov. 17, 2015, 18 pages.
Tsunoda, Y. et al., "Improving Expression and Solubility of Rice Proteins Produced as Fusion Proteins in *Escherichia coli*," Protein Expr. Purif., Aug. 2005, pp. 268-277, vol. 42, No. 2.
United States Office Action, U.S. Appl. No. 14/337,563, Jun. 26, 2015, 11 pages.

(56) References Cited

OTHER PUBLICATIONS

United States Restriction Requirement, U.S. Appl. No. 14/387,675, Jun. 25, 2015, 8 pages.
United States Restriction Requirement, U.S. Appl. No. 14/387,677, Jun. 25, 2015, 8 pages.
United States Restriction Requirement, U.S. Appl. No. 14/387,679, Sep. 22, 2015, 8 pages.
United States Restriction Requirement, U.S. Appl. No. 14/387,684, Oct. 23, 2015, 8 pages.
Churchward-Venne, T.A. et al. "Ingestion of Casein in a Milk Matrix Modulates Dietary Protein Digestion and Absorption Kinetics but Does Not Modulate Postprandial Muscle Protein Synthesis in Older Men" Journal of Nutrition, 2015; 145:1438-45.
Halachmi, D. et al., "Calcium Homeostasis in Yeast Cells Exposed to High Concentrations of Calcium Roles of Vacuolar H+−ATPase and Cellular ATP" FEBS 1993; 316(1): 73-78.
"Lactose, Fat & Other Proteins Impair Digestion of Micellar Casein W/Out Modifying Protein Synthesis or Breakdown," SuppVersity—Nutrition and Exercise Science for Everyone, Jun. 4, 2015, 3 pages, [Online] [Retrieved on Jun. 29, 2016] Retrieved from the Internet<URL:http://suppversity.blogspot.com/2015/06/lactosefatotherproteinsimpair.html>.
Valli, M. et al. "Intracellular pH Distribution in Saccharomyces cerevisiae Cell Populations, Analyzed by Flow Cytometry" Applied and Environmental Microbiology, 2005; 71(3): 1515-1521.
Australian First Examination Report, Australian Application No. 2013240271, Oct. 19, 2016, 4 pages.
Australian First Examination Report, Australian Application No. 2013240184, Oct. 19, 2016, 4 pages.
Chinese Second Office Action, Chinese Application No. 201380027365.7, Nov. 28, 2016, 5 pages. (with concise explanation of relevance).
European Examination Report, European Application No. 13770153.8, Oct. 27, 2016, 5 pages.
European Examination Report, European Application No. 13770012.6, Nov. 8, 2016, 4 pages.
European Extended Search Report, European Application No. 13767426.3, Nov. 9, 2016, 18 pages.
European Examination Report, European Application No. 13768128.4, Nov. 29, 2016, 7 pages.
Itoh, K. et al., "Neuronal Cell Expression of Inserted Isoforms of Vertebrate Nonmuscle Myosin Heavy Chain II-B," The Journal of Biological Chemistry, Jun. 1995, pp. 14533-14540, vol. 279, No. 24.
Russian Office Action, Russian Application No. 2014143031/10(069502), Sep. 7, 2016, 9 pages.
Russian Office Action, Russian Application No. 2014143029/10(069500), Oct. 20, 2016, 10 pages.
United States Miscellaneous Communication to Applicant, U.S. Appl. No. 14/387,679, Sep. 20, 2016, 2 pages.
United States Miscellaneous Communication to Applicant, U.S. Appl. No. 14/387,675, Oct. 20, 2016, 6 pages.
United States Office Action, U.S. Appl. No. 14/387,677, Oct. 20, 2016, 17 pages.
Chinese First Office Action, Chinese Application No. 201380027476.8, Jun. 28, 2016, 19 pages.
Davis, T.N. et al., "Isolation of the Yeast Calmodulin Gene: Calmodulin is an Essential Protein," Cell, Cell Press, Nov. 7, 1986, pp. 423-431, vol. 47, No. 3.
European Partial Supplementary Search Report, European Application No. 13767426.3, Jul. 19, 2016, 11 pages.
Israel Office Action, Israel Application No. 234617, Sep. 5, 2016, 3 pages. (with concise explanation of relevance).
United States Office Action, U.S. Appl. No. 14/387,679, Jul. 14, 2016, 10 pages.
United States Office Action, U.S. Appl. No. 14/337,563, Sep. 30, 2016, 11 pages.
United States Office Action, U.S. Appl. No. 14/387,684, Oct. 5, 2016, 10 pages.

* cited by examiner

NUTRITIVE FRAGMENTS, PROTEINS AND METHODS

REFERENCE TO RELATED APPLICATION

This application is a 371 application which claims priority to PCT/US2013/032218, filed Mar. 15, 2013, which claims priority to U.S. Provisional Patent Application No. 61/615,819, filed Mar. 26, 2012, each of which is hereby incorporated herein by reference in its entirety, for all purposes.

SEQUENCE LISTING

The instant application contains a Sequence Listing which has been submitted in ASCII format via EFS-Web and is hereby incorporated by reference in its entirety. Said ASCII copy, created on Mar. 12, 2013, is named 1005.005-PCT_SL.txt and is 3,234,600 bytes in size.

INTRODUCTION

Dietary protein is an essential nutrient for human health and growth. The World Health Organization recommends that dietary protein should contribute approximately 10 to 15% of energy intake when in energy balance and weight stable. Average daily protein intakes in various countries indicate that these recommendations are consistent with the amount of protein being consumed worldwide. Meals with an average of 20 to 30% of energy from protein are representative of high-protein diets when consumed in energy balance.

The body cannot synthesize certain amino acids that are necessary for health and growth, and instead must obtain them from food. These amino acids, called "essential amino acids", are Histidine (H), Isoleucine (I), Leucine (L), Lysine (K), Methionine (M), Phenylalanine (F), Threonine (T), Tryptophan (W), and Valine (V). Dietary proteins that provide all the essential amino acids are referred to as "high quality" proteins. Animal foods such as meat, fish, poultry, eggs, and dairy products are generally regarded as high quality protein sources that provide a good balance of essential amino acids. Casein (a protein commonly found in mammalian milk, making up 80% of the proteins in cow milk) and whey (the protein in the liquid that remains after milk has been curdled and strained) are major sources of high quality dietary protein. Foods that do not provide a good balance of essential amino acids are referred to as "low quality" proteins. Most fruits and vegetables are poor sources of protein. Some plants foods including beans, peas, lentils, nuts and grains (such as wheat) are better sources of protein. Soy, a vegetable protein manufactured from soybeans, is considered by some to be a high quality protein.

Studies of the acute effects of consuming high amounts of protein in humans have shown that inclusion and in some cases increasing protein content in the diet can have beneficial effects. For example, studies have shown that ingestion of protein can induce postprandial satiety (including by suppressing hunger), induce thermogenesis and reduce glycemic response in human subjects.

Studies of high protein diets for weight loss have shown that protein positively affects energy expenditure and lean body mass. Further studies have shown that overeating produces significantly less weight gain in diets containing at least 5% of energy from protein, and that a high-protein diet decreases energy intake.

Clinical studies provide evidence that protein prevents muscle loss due to aging or bed rest. In particular, studies have shown that protein supplementation increases muscle fractional synthetic rate (FSR) during prolonged bed rest, maintains leg mass and strength during prolonged bed rest increases lean body mass, improves functional measures of gait and balance, and may serve as a viable intervention for individuals at risk of sarcopenia due to immobility or prolonged bed rest.

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, milk proteins appear to be superior to soy in supporting muscle mass accretion with resistance training, while both are superior to carbohydrate alone. The amino acid leucine is an important factor in stimulating muscle protein synthesis.

Whole proteins commonly found in foods do not necessarily provide an amino acid composition that meets the amino acid requirements of a mammal, such as a human, in an efficient manner. The result is that, in order to attain the minimal requirements of each essential amino acid, a larger amount of total protein must be consumed in the diet than would be required if the quality of the dietary protein were higher. By increasing the quality of the protein in the diet it is possible to reduce the total amount of protein that must be consumed compared to diets that include lower quality proteins.

In general, proteins that have higher protein quality are considered more beneficial in a mammalian diet than other proteins that do not. Such proteins are useful, for example, as components of a mammalian diet. Under certain circumstances such proteins promote maintenance of muscle mass, a healthy body mass index, and glycemic balance, among other things. Accordingly, there is a need for sources of proteins that have high protein quality.

Traditionally, desirable mixtures of amino acids, such as mixtures comprising essential amino acids, have been provided by hydrolyzing a protein with relatively high levels of essential amino acids, such as whey protein, and/or by combining free amino acids in a mixture that optionally also includes a hydrolyzed protein such as whey. Mixtures of this type may have a bitter taste and may be deemed unsuitable or undesirable for certain uses. As a result, such mixtures sometimes include flavoring agents to mask the taste of the free amino acids and/or hydrolyzed protein. In some cases compositions in which a proportion of the amino acid content is provided by polypeptides or proteins are found to have a better taste than compositions with a high proportion of total amino acids provided as free amino acids and/or certain hydrolyzed proteins. The availability of such compositions has been limited, however, because nutritional formulations have traditionally been made from protein isolated from natural food products, such as whey isolated from milk, or soy protein isolated from soy. The amino acid profiles of those proteins do not necessarily meet the amino acid requirements for a mammal. In addition, commodity proteins typically consist of mixtures of proteins and/or protein hydrolysates which can vary in their protein composition, thus leading to unpredictability regarding their nutritional value. Moreover, the limited number of sources of such high quality proteins has meant that only certain combinations of amino acids are available on a large scale for ingestion in protein form.

The agricultural methods required to supply high quality animal protein sources such as casein and whey, eggs, and meat, as well as plant proteins such as soy, also require significant energy inputs and have potentially deleterious environmental impacts. Accordingly, it would be useful in certain situations to have alternative sources and methods of supplying proteins for mammalian consumption.

In theory, synthetic polypeptide sequences comprising a desired mixture of amino acids could be designed and produced in a laboratory setting. This approach may raise various concerns, however, and is therefore not always applicable. First, skilled artisans are aware that obtaining high levels of production of such synthetic sequences may be very challenging. Second, even if such a synthetic protein were synthesized, its suitability for use in a nutritive product would be uncertain. For example, such a non-naturally occurring polypeptide could be an allergen or a toxin. Accordingly, in some embodiments this disclosure provides natural protein or polypeptide sequences, or variants thereof.

In this disclosure the inventors provide nutritive proteins comprising a first polypeptide sequence that is homologous to a fragment of a naturally-occurring protein. The nutritive proteins and the fragments of which they are composed are made up of useful combinations of amino acids. The proteins can be produced by methods that do not rely solely on traditional agriculture for production. For example, the inventors have discovered and this disclosure provides nutritive proteins comprising a fragment of a naturally-occurring protein and composed of combinations of amino acids that contain a useful level of at least one of a ratio of branch chain amino acids to total amino acids, a ratio of the amino acid leucine to total amino acids, and a ratio essential amino acids to total amino acids. In some embodiments the nutritive proteins comprise at least one of a level of a) a ratio of branch chain amino acid residues to total amino acid residues present in the nutritive protein equal to or greater than the ratio of branch chain amino acid residues to total amino acid residues present in whey protein; b) a ratio of leucine residues to total amino acid residues present in the nutritive protein equal to or greater than the ratio of leucine residues to total amino acid residues present in whey protein; and c) a ratio of essential amino acid residues to total amino acid residues present in the nutritive protein equal to or greater than the ratio of essential amino acid residues to total amino acid residues present in whey protein.

This disclosure also provides nucleic acids encoding the proteins, recombinant microorganisms that make the proteins, methods of making the proteins using recombinant microorganisms, compositions that comprise the proteins, and methods of using the proteins, among other things.

SUMMARY

In a first aspect this disclosure provides isolated nutritive proteins comprising a first polypeptide sequence that is homologous to a fragment of a naturally-occurring protein, wherein the first polypeptide sequence comprises at least one of: a. a ratio of branch chain amino acid residues to total amino acid residues of at least 24%; b. a ratio of Leu residues to total amino acid residues of at least 11%; and c. a ratio of essential amino acid residues to total amino acid residues of at least 49%. In some embodiments the first polypeptide sequence further comprises at least one of each essential amino acid. In some embodiments the first polypeptide sequence comprises at least 70% homology to the fragment of a naturally-occurring protein. In some embodiments the first polypeptide sequence comprises at least 95% homology to the fragment of a naturally-occurring protein. In some embodiments the fragment of a naturally-occurring protein comprises at least 25 amino acid residues. In some embodiments the fragment of a naturally-occurring protein comprises at least 50 amino acid residues. In some embodiments the first polypeptide sequence comprises: a. a ratio of branch chain amino acid residues to total amino acid residues of at least 24%; b. a ratio of Leu residues to total amino acid residues of at least 11%; and c. a ratio of essential amino acid residues to total amino acid residues of at least 49%. In some embodiments the first polypeptide sequence comprises a fragment of a naturally-occurring nutritive protein. In some embodiments the first polypeptide sequence consists of a fragment of a naturally-occurring nutritive protein.

In some embodiments the first polypeptide sequence is not an allergen. In some embodiments the first polypeptide sequence has less than 50% global homology to a known allergen.

In some embodiments the first polypeptide sequence is not a toxin. In some embodiments the first polypeptide sequence has less than 50% global homology to a known toxin.

In some embodiments the first polypeptide sequence has a simulated gastric digestion half-life of less than 60 minutes. In some embodiments the first polypeptide sequence has a simulated gastric digestion half-life of less than 30 minutes. In some embodiments the first polypeptide sequence has a simulated gastric digestion half-life of less than 10 minutes. In some embodiments the first polypeptide sequence is completely digested in simulated gastric fluid. In some embodiments the first polypeptide sequence comprises at least one protease recognition site selected from a pepsin recognition site, a trypsin recognition site, and a chymotrypsin recognition site. In some embodiments the first polypeptide sequence comprises no cysteine residues. In some embodiments the first polypeptide sequence comprises no disulfide bonds. In some embodiments the first polypeptide sequence does not comprise N-linked glycosylation. In some embodiments the first polypeptide sequence does not comprise O-linked glycosylation.

In some embodiments the first polypeptide sequence is resistant to aggregation. In some embodiments the first polypeptide sequence is anionic at pH 7. In some embodiments the first polypeptide sequence has an aqueous solubility at pH 7 of at least 12.5 g/L. In some embodiments the first polypeptide sequence has a calculated solvation score of −20 or less. In some embodiments the first polypeptide sequence has a calculated aggregation score of 0.75 or less. In some embodiments the first polypeptide sequence has a calculated aggregation score of 0.5 or less.

In some embodiments the first polypeptide sequence comprises an amino acid sequence selected from: i. an amino acid sequence selected from SEQ ID NO: 1 to SEQ ID NO: 2609; ii. a modified derivative of an amino acid sequence selected from SEQ ID NO: 1 to SEQ ID NO: 2609; and iii. a mutein of an amino acid sequence selected from SEQ ID NO: 1 to SEQ ID NO: 2609. In some embodiments the first polypeptide sequence consists of an amino acid sequence selected from: i. an amino acid sequence selected from SEQ ID NO: 1 to SEQ ID NO: 2609; ii. a modified derivative of an amino acid sequence selected from SEQ ID NO: 1 to SEQ ID NO: 2609; and iii. a mutein of an amino acid sequence selected from v. In some embodiments the first polypeptide sequence is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one amino acid sequence selected from SEQ ID NO: 1 to SEQ ID NO: 2609.

In some embodiments the first polypeptide sequence is a fragment of at least 25 amino acids of the naturally-occurring nutritive protein. In some embodiments the first polypeptide sequence is a fragment of at least 50 amino acids of the naturally-occurring nutritive protein. In some embodiments the isolated nutritive protein consists of the first polypeptide sequence. In some embodiments the isolated nutritive protein further comprises a polypeptide tag for affinity purification. In some embodiments the tag for affinity purification is a polyhistidine-tag.

In another aspect this disclosure provides isolated nutritive proteins comprising a first polypeptide sequence that is homologous to a fragment of a naturally-occurring protein, wherein the isolated nutritive protein comprises at least one of: a. a ratio of branch chain amino acid residues to total amino acid residues of at least 24%; b. a ratio of Leu residues to total amino acid residues of at least 11%; and c. a ratio of essential amino acid residues to total amino acid residues of at least 49%. In some embodiments the isolated nutritive protein further comprises at least one of each essential amino acid. In some embodiments the isolated nutritive protein comprises at least 70% homology to the fragment of a naturally-occurring protein. In some embodiments the isolated nutritive protein comprises at least 95% homology to the fragment of a naturally-occurring protein. In some embodiments the fragment of a naturally-occurring protein comprises at least 25 amino acid residues. In some embodiments the fragment of a naturally-occurring protein comprises at least 50 amino acid residues. In some embodiments the isolated nutritive protein comprises: a. a ratio of branch chain amino acid residues to total amino acid residues of at least 24%; b. a ratio of Leu residues to total amino acid residues of at least 11%; and c. a ratio of essential amino acid residues to total amino acid residues of at least 49%. In some embodiments the isolated nutritive protein comprises a fragment of a naturally occurring nutritive protein. In some embodiments the isolated nutritive protein consists of a fragment of a naturally occurring nutritive protein.

In some embodiments the isolated nutritive protein is not an allergen. In some embodiments the isolated nutritive protein has less than 50% global homology to a known allergen.

In some embodiments the isolated nutritive protein is not a toxin. In some embodiments the isolated nutritive protein has less than 50% global homology to a known toxin.

In some embodiments the isolated nutritive protein has a simulated gastric digestion half-life of less than 60 minutes. In some embodiments the isolated nutritive protein has a simulated gastric digestion half-life of less than 30 minutes. In some embodiments the isolated nutritive protein has a simulated gastric digestion half-life of less than 10 minutes. In some embodiments the isolated nutritive protein is completely digested in simulated gastric fluid. In some embodiments the isolated nutritive protein comprises at least one protease recognition site selected from a pepsin recognition site, a trypsin recognition site, and a chymotrypsin recognition site. In some embodiments the isolated nutritive protein comprises no cysteine residues. In some embodiments the isolated nutritive protein comprises no disulfide bonds. In some embodiments the isolated nutritive protein does not comprise N-linked glycosylation. In some embodiments the isolated nutritive protein does not comprise O-linked glycosylation.

In some embodiments the isolated nutritive protein is resistant to aggregation. In some embodiments the isolated nutritive protein is anionic at pH 7. In some embodiments the isolated nutritive protein has an aqueous solubility at pH 7 of at least 12.5 g/L. In some embodiments the isolated nutritive protein has a calculated solvation score of −20 or less. In some embodiments the isolated nutritive protein has a calculated aggregation score of 0.75 or less. In some embodiments the isolated nutritive protein has a calculated aggregation score of 0.5 or less.

In some embodiments the isolated nutritive protein comprises an amino acid sequence selected from: i. an amino acid sequence selected from SEQ ID NO: 1 to SEQ ID NO: 2609; ii. a modified derivative of an amino acid sequence selected from SEQ ID NO: 1 to SEQ ID NO: 2609; and iii. a mutein of an amino acid sequence selected from SEQ ID NO: 1 to SEQ ID NO: 2609. In some embodiments the isolated nutritive protein consists of an amino acid sequence selected from: i. an amino acid sequence selected from SEQ ID NO: 1 to SEQ ID NO: 2609; ii. a modified derivative of an amino acid sequence selected from SEQ ID NO: 1 to SEQ ID NO: 2609; and iii. a mutein of an amino acid sequence selected from SEQ ID NO: 1 to SEQ ID NO: 2609. In some embodiments the isolated nutritive protein is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one amino acid sequence selected from SEQ ID NO: 1 to SEQ ID NO: 2609. In some embodiments the isolated nutritive protein further comprises a polypeptide tag for affinity purification. In some embodiments the tag for affinity purification is a polyhistidine-tag.

In another aspect this disclosure provides isolated nucleic acids comprising a nucleic acid sequence that encodes a nutritive protein according to this disclosure. In some embodiments the isolated nucleic acid is selected from genomic DNA, cDNA, sense RNA and antisense RNA. In some embodiments the isolated nucleic acid is genomic DNA. In some embodiments the isolated nucleic acid is cDNA. In some embodiments the isolated nucleic acid further comprises an expression control sequence operatively linked to the nucleic acid sequence that encodes the nutritive protein. In some embodiments the nucleic acid sequence that encodes a nutritive protein according to this disclosure is present in a vector. In some embodiments the vector further comprises an expression control sequence operatively linked to the nucleic acid sequence that encodes the nutritive protein.

In another aspect this disclosure provides recombinant microorganisms comprising at least one of a nucleic acid and a vector according to this disclosure. In some embodiments the recombinant microorganism is a prokaryote. In some embodiments the prokaryote is heterotrophic. In some embodiments the prokaryote is autotrophic. In some embodiments the prokaryote is a bacteria.

In another aspect this disclosure provides methods of making a nutritive protein according to this disclosure, the method comprising culturing a recombinant microorganism according to this disclosure under conditions sufficient for production of the nutritive protein by the recombinant microorganism. In some embodiments the method further comprises isolating the nutritive protein from the culture.

In another aspect this disclosure nutritive compositions comprising a nutritive protein of of this disclosure and at least one second component. In some embodiments the at least one second component is selected from a protein, a polypeptide, a peptide, a free amino acid, a carbohydrate, a fat, a mineral or mineral source, a vitamin, a supplement, an organism, a pharmaceutical, and an excipient. In some embodiments the at least one second component is a protein. In some embodiments the at least one second component is a nutritive protein. In some embodiments the at least one second component is a free amino acid selected from essential amino acids, non-essential amino acids, branch chain amino acids, non-standard amino acids and modified amino acids. In some embodiments the at least one second component is a free amino acid selected from essential amino acids. In some embodiments the at least one second component is a free amino acid selected from branch chain amino acids. In some embodiments the at least one second component is Leu. In some embodiments the at least one second component is a lipid. In some embodiments the lipid is selected from a fat, oil, triglyceride, cholesterol, phospholipid, and fatty acid. In some embodiments the at least one second component is selected from a mineral and a vitamin. In some embodiments the at least one second component is a supplement. In some embodiments the at least one second component is an organism. In some embodiments the at least one second component is a pharmaceutical. In some embodiments the at least one second component is an excipient. In some embodiments the at least one excipient is selected from a buffering agent, a preservative, a stabilizer, a binder, a compaction agent, a lubricant, a dispersion enhancer, a disintegration agent, a flavoring agent, a sweetener, a coloring agent. In some embodiments the nutritive composition is formulated as a liquid solution, slurry, suspension, gel, paste, powder, or solid.

In another aspect this disclosure provides methods of making a nutritive composition of this disclosure, comprising providing a nutritive protein according to this disclosure and combining the nutritive protein with the at least one second component.

In another aspect this disclosure provides methods of maintaining or increasing at least one of muscle mass, muscle strength, and functional performance in a subject, the method comprising providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of maintaining or achieving a desirable body mass index in a subject, the method comprising providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of providing protein to a subject with protein-energy malnutrition, the method comprising providing to the subject a sufficient amount of a nutritive protein of this disclosure, a nutritive composition of this disclosure, or a nutritive composition made by a method of this disclosure. In some embodiments the subject is obese. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of increasing thermogenesis in a subject, the method comprising providing to the subject a sufficient amount of a nutritive protein of this disclosure, a nutritive composition of this disclosure, or a nutritive composition made by a method of this disclosure. In some embodiments the subject is obese. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of inducing at least one of a satiation response and a satiety response in a subject, the method comprising providing to the subject a sufficient amount of a nutritive protein of this disclosure, a nutritive composition of this disclosure, or a nutritive composition made by a method of this disclosure. In some embodiments the subject is obese. In some embodiments the nutritive protein of this disclosure, nutritive composition of this disclosure, or nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of treating at least one of cachexia, sarcopenia and frailty in a subject, the method comprising providing to the subject a sufficient amount of a nutritive protein of this disclosure, a nutritive composition of this disclosure, or a nutritive composition made by a method of this disclosure. In some embodiments the nutritive protein of this disclosure, nutritive composition of this disclosure, or nutritive composition made by a method of this disclosure is consumed by the subject by an oral, enteral, or parenteral route.

DETAILED DESCRIPTION

Figure 1:
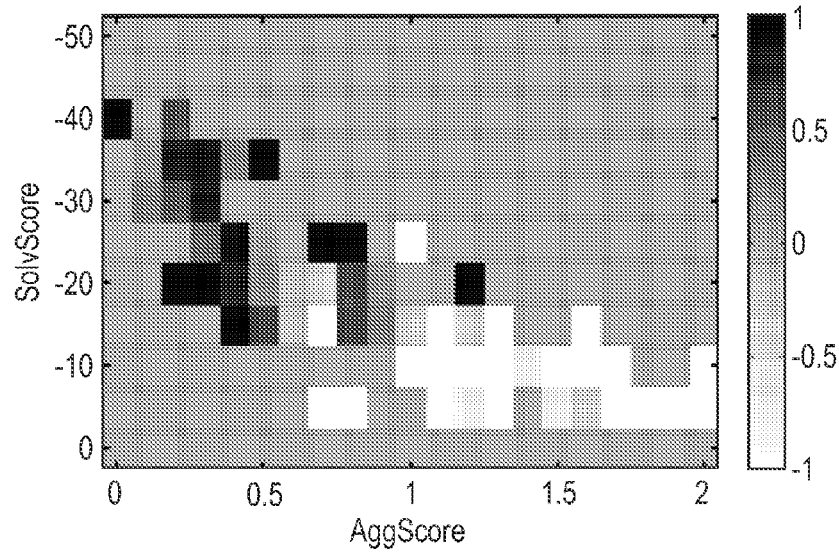
FIG. 1 shows a two dimensional histogram indicating the relative likelihood (on a log scale) of a protein being expressed in an *E. coli* expression screen as a function of solvation score (y-axis) and aggregation score (x-axis).

Unless otherwise defined herein, scientific and technical terms used in connection with the present disclosure shall have the meanings that are commonly understood by those of ordinary skill in the art. Further, unless otherwise required by context, singular terms shall include the plural and plural terms shall include the singular. Generally, nomenclatures used in connection with, and techniques of, biochemistry, enzymology, molecular and cellular biology, microbiology, genetics and protein and nucleic acid chemistry and hybridization described herein are those well-known and commonly used in the art. Certain references and other documents cited herein are expressly incorporated herein by reference. Additionally, all UniProt/SwissProt records cited herein are hereby incorporated herein by reference. In case of conflict, the present specification, including definitions, will control. The materials, methods, and examples are illustrative only and not intended to be limiting.

The methods and techniques of the present disclosure are generally performed according to conventional methods well known in the art and as described in various general and more specific references that are cited and discussed throughout the present specification unless otherwise indicated. See, e.g., Sambrook et al., Molecular Cloning: A Laboratory Manual, 3d ed., Cold Spring Harbor Laboratory Press, Cold Spring Harbor, N.Y. (2001); Ausubel et al., Current Protocols in Molecular Biology, Greene Publishing Associates (1992, and Supplements to 2002); Taylor and Drickamer, Introduction to Glycobiology, Oxford Univ. Press (2003); Worthington Enzyme Manual, Worthington Biochemical Corp., Freehold, N.J.; Handbook of Biochemistry: Section A Proteins, Vol I, CRC Press (1976); Handbook of Biochemistry: Section A Proteins, Vol II, CRC Press (1976); Essentials of Glycobiology, Cold Spring Harbor Laboratory Press (1999). Many molecular biology and genetic techniques applicable to cyanobacteria are described in Heidorn et al., "Synthetic Biology in Cyanobacteria: Engineering and Analyzing Novel Functions," Methods in Enzymology, Vol. 497, Ch. 24 (2011), which is hereby incorporated herein by reference.

This disclosure refers to sequence database entries (e.g., UniProt/SwissProt) for certain protein and gene sequences that are published on the internet, as well as other information on the internet. The skilled artisan understands that information on the internet, including sequence database entries, is updated from time to time and that, for example, the reference number used to refer to a particular sequence can change. Where reference is made to a public database of sequence information or other information on the internet, it is understood that such changes can occur and particular embodiments of information on the internet can come and go. Because the skilled artisan can find equivalent information by searching on the internet, a reference to an internet web page address or a sequence database entry evidences the availability and public dissemination of the information in question.

Before the present proteins, compositions, methods, and other embodiments are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise.

The term "comprising" as used herein is synonymous with "including" or "containing", and is inclusive or open-ended and does not exclude additional, unrecited members, elements or method steps.

This disclosure makes reference to amino acids. The full name of the amino acids is used interchangeably with the standard three letter and one letter abbreviations for each. For the avoidance of doubt, those are: Alanine (Ala, A), Arginine (Arg, R), Asparagine (Asn, N), Aspartic acid (Asp, D), Cysteine (Cys, C), Glutamic Acid (Glu, E), Glutamine (Gln, Q), Glycine (Gly, G), Histidine (His, H), Isoleucine (Ile, I), Leucine (Leu, L), Lysine (Lys, K), Methionine (Met, M), Phenylalanine (Phe, F), Proline (Pro, P), Serine (Ser, S), Threonine (Thr, T), Tryptophan (Trp, W), Tyrosine (Tyr, Y), Valine (Val, V).

As used herein, the term "in vitro" refers to events that occur in an artificial environment, e.g., in a test tube or reaction vessel, in cell culture, in a Petri dish, etc., rather than within an organism (e.g., animal, plant, or microbe).

As used herein, the term "in vivo" refers to events that occur within an organism (e.g., animal, plant, or microbe).

As used herein, the term "isolated" refers to a substance or entity that has been (1) separated from at least some of the components with which it was associated when initially produced (whether in nature or in an experimental setting), and/or (2) produced, prepared, and/or manufactured by the hand of man. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

As used herein, a "branch chain amino acid" is an amino acid selected from Leucine, Isoleucine, and Valine.

As used herein, an "essential amino acid" is an amino acid selected from Histidine, Isoleucine, Leucine, Lysine, Methionine, Phenylalanine, Threonine, Tryptophan, and Valine.

The term "peptide" as used herein refers to a short polypeptide, e.g., one that typically contains less than about 50 amino acids and more typically less than about 30 amino acids. The term as used herein encompasses analogs and mimetics that mimic structural and thus biological function.

The term "polypeptide" encompasses both naturally-occurring and non-naturally occurring proteins, and fragments, mutants, derivatives and analogs thereof. A polypeptide may be monomeric or polymeric. Further, a polypeptide may comprise a number of different domains each of which has one or more distinct activities. For the avoidance of doubt, a "polypeptide" may be any length greater two amino acids.

The term "isolated protein" or "isolated polypeptide" is a protein or polypeptide that by virtue of its origin or source of derivation (1) is not associated with naturally associated components that accompany it in its native state, (2) exists in a purity not found in nature, where purity can be adjudged with respect to the presence of other cellular material (e.g., is free of other proteins from the same species) (3) is expressed by a cell from a different species, or (4) does not occur in nature (e.g., it is a fragment of a polypeptide found in nature or it includes amino acid analogs or derivatives not found in nature or linkages other than standard peptide bonds). Thus, a polypeptide that is chemically synthesized or synthesized in a cellular system different from the cell from which it naturally originates will be "isolated" from its naturally associated components. A polypeptide or protein may also be rendered substantially free of naturally associated components by isolation, using protein purification techniques well known in the art. As thus defined, "isolated" does not necessarily require that the protein, polypeptide, peptide or oligopeptide so described has been physically removed from a cell in which it was synthesized.

The term "polypeptide fragment" as used herein refers to a polypeptide that has a deletion, e.g., an amino-terminal and/or carboxy-terminal deletion compared to a full-length polypeptide, such as a naturally occurring protein. In an embodiment, the polypeptide fragment is a contiguous sequence in which the amino acid sequence of the fragment is identical to the corresponding positions in the naturally-occurring sequence. Fragments typically are at least 5, 6, 7, 8, 9 or 10 amino acids long, or at least 12, 14, 16 or 18 amino acids long, or at least 20 amino acids long, or at least 25, 30, 35, 40 or 45, amino acids, or at least 50 or 60 amino acids long, or at least 70 amino acids long.

The term "fusion protein" refers to a polypeptide comprising a polypeptide or fragment coupled to heterologous amino acid sequences. Fusion proteins are useful because they can be constructed to contain two or more desired functional elements that can be from two or more different proteins. A fusion protein comprises at least 10 contiguous amino acids from a polypeptide of interest, or at least 20 or 30 amino acids, or at least 40, 50 or 60 amino acids, or at least 75, 100 or 125 amino acids. The heterologous polypeptide included within the fusion protein is usually at least 6 amino acids in length, or at least 8 amino acids in length, or at least 15, 20, or 25 amino acids in length. Fusions that include larger polypeptides, such as an IgG Fc region, and even entire proteins, such as the green fluorescent protein ("GFP") chromophore-containing proteins, have particular utility. Fusion proteins can be produced recombinantly by constructing a nucleic acid sequence which encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

As used herein, a protein has "homology" or is "homologous" to a second protein if the nucleic acid sequence that encodes the protein has a similar sequence to the nucleic acid sequence that encodes the second protein. Alternatively, a protein has homology to a second protein if the two proteins have similar amino acid sequences. (Thus, the term "homologous proteins" is defined to mean that the two proteins have similar amino acid sequences.) As used herein, homology between two regions of amino acid sequence (especially with respect to predicted structural similarities) is interpreted as implying similarity in function.

When "homologous" is used in reference to proteins or peptides, it is recognized that residue positions that are not identical often differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art. See, e.g., Pearson, 1994, Methods Mol. Biol. 24:307-31 and 25:365-89.

The following six groups each contain amino acids that are conservative substitutions for one another: 1) Serine, Threonine; 2) Aspartic Acid, Glutamic Acid; 3) Asparagine, Glutamine; 4) Arginine, Lysine; 5) Isoleucine, Leucine, Methionine, Alanine, Valine, and 6) Phenylalanine, Tyrosine, Tryptophan.

Sequence homology for polypeptides, which is also referred to as percent sequence identity, is typically measured using sequence analysis software. See, e.g., the Sequence Analysis Software Package of the Genetics Computer Group (GCG), University of Wisconsin Biotechnology Center, 910 University Avenue, Madison, Wis. 53705. Protein analysis software matches similar sequences using a measure of homology assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild-type protein and a mutein thereof. See, e.g., GCG Version 6.1.

An exemplary algorithm when comparing a particular polypeptide sequence to a database containing a large number of sequences from different organisms is the computer program BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

Exemplary parameters for BLASTp are: Expectation value: 10 (default); Filter: seg (default); Cost to open a gap: 11 (default); Cost to extend a gap: 1 (default); Max. alignments: 100 (default); Word size: 11 (default); No. of descriptions: 100 (default); Penalty Matrix: BLOWSUM62. The length of polypeptide sequences compared for homology will generally be at least about 16 amino acid residues, or at least about 20 residues, or at least about 24 residues, or at least about 28 residues, or more than about 35 residues. When searching a database containing sequences from a large number of different organisms, it may be useful to compare amino acid sequences. Database searching using amino acid sequences can be measured by algorithms other than blastp known in the art. For instance, polypeptide sequences can be compared using FASTA, a program in GCG Version 6.1. FASTA provides alignments and percent sequence identity of the regions of the best overlap between the query and search sequences. Pearson, Methods Enzymol. 183:63-98 (1990). For example, percent sequence identity between amino acid sequences can be determined using FASTA with its default parameters (a word size of 2 and the PAM250 scoring matrix), as provided in GCG Version 6.1, herein incorporated by reference.

In some embodiments, polymeric molecules (e.g., a polypeptide sequence or nucleic acid sequence) are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% similar. The term "homologous" necessarily refers to a comparison between at least two sequences (nucleotides sequences or amino acid sequences). In some embodiments, two nucleotide sequences are considered to be homologous if the polypeptides they encode are at least about 50% identical, at least about 60% identical, at least about 70% identical, at least about 80% identical, or at least about 90% identical for at least one stretch of at least about 20 amino acids. In some embodiments, homologous nucleotide sequences are characterized by the ability to encode a stretch of at least 4-5 uniquely specified amino acids. Both the identity and the approximate spacing of these amino acids relative to one another must be considered for nucleotide sequences to be considered homologous. In some embodiments of nucleotide sequences less than 60 nucleotides in length, homology is determined by the ability to encode a stretch of at least 4-5 uniquely specified amino acids. In some embodiments, two protein sequences are considered to be homologous if the proteins are at least about 50% identical, at least about 60% identical, at least about 70% identical, at least about 80% identical, or at least about 90% identical for at least one stretch of at least about 20 amino acids.

As used herein, a "modified derivative" refers to polypeptides or fragments thereof that are substantially homologous in primary structural sequence to a reference polypeptide sequence but which include, e.g., in vivo or in vitro chemical and biochemical modifications or which incorporate amino acids that are not found in the reference polypeptide. Such modifications include, for example, acetylation, carboxylation, phosphorylation, glycosylation, ubiquitination, labeling, e.g., with radionuclides, and various enzymatic modifications, as will be readily appreciated by those skilled in the art. A variety of methods for labeling polypeptides and of substituents or labels useful for such purposes are well known in the art, and include radioactive isotopes such as $^{125}I$, $^{32}P$, $^{35}S$, and H, ligands that bind to labeled antiligands (e.g., antibodies), fluorophores, chemiluminescent agents, enzymes, and antiligands that can serve as specific binding pair members for a labeled ligand. The choice of label depends on the sensitivity required, ease of conjugation with the primer, stability requirements, and available instrumentation. Methods for labeling polypeptides are well known in the art. See, e.g., Ausubel et al., Current Protocols in Molecular Biology, Greene Publishing Associates (1992, and Supplements to 2002).

As used herein, "polypeptide mutant" or "mutein" refers to a polypeptide whose sequence contains an insertion, duplication, deletion, rearrangement or substitution of one or more amino acids compared to the amino acid sequence of a reference protein or polypeptide, such as a native or wild-type protein. A mutein may have one or more amino acid point substitutions, in which a single amino acid at a position has been changed to another amino acid, one or more insertions and/or deletions, in which one or more amino acids are inserted or deleted, respectively, in the sequence of the reference protein, and/or truncations of the amino acid sequence at either or both the amino or carboxy termini. A mutein may have the same or a different biological activity compared to the reference protein.

In some embodiments, a mutein has, for example, at least 85% overall sequence homology to its counterpart reference protein. In some embodiments, a mutein has at least 90% overall sequence homology to the wild-type protein. In other embodiments, a mutein exhibits at least 95% sequence identity, or 98%, or 99%, or 99.5% or 99.9% overall sequence identity.

As used herein, a "polypeptide tag for affinity purification" is any polypeptide that has a binding partner that can be used to isolate or purify a second protein or polypeptide sequence of interest fused to the first "tag" polypeptide. Several examples are well known in the art and include a His-6 tag, a FLAG epitope, a c-myc epitope, a Strep-TAGII, a biotin tag, a glutathione 5-transferase (GST), a chitin binding protein (CBP), a maltose binding protein (MBP), or a metal affinity tag.

As used herein, "recombinant" refers to a biomolecule, e.g., a gene or protein, that (1) has been removed from its naturally occurring environment, (2) is not associated with all or a portion of a polynucleotide in which the gene is found in nature, (3) is operatively linked to a polynucleotide which it is not linked to in nature, or (4) does not occur in nature. The term "recombinant" can be used in reference to cloned DNA isolates, chemically synthesized polynucleotide analogs, or polynucleotide analogs that are biologically synthesized by heterologous systems, as well as proteins and/or mRNAs encoded by such nucleic acids. Thus, for example, a protein synthesized by a microorganism is recombinant, for example, if it is synthesized from an mRNA synthesized from a recombinant gene present in the cell.

The term "polynucleotide", "nucleic acid molecule", "nucleic acid", or "nucleic acid sequence" refers to a polymeric form of nucleotides of at least 10 bases in length. The term includes DNA molecules (e.g., cDNA or genomic or synthetic DNA) and RNA molecules (e.g., mRNA or synthetic RNA), as well as analogs of DNA or RNA containing non-natural nucleotide analogs, non-native internucleoside bonds, or both. The nucleic acid can be in any topological conformation. For instance, the nucleic acid can be single-stranded, double-stranded, triple-stranded, quadruplexed, partially double-stranded, branched, hairpinned, circular, or in a padlocked conformation.

A "synthetic" RNA, DNA or a mixed polymer is one created outside of a cell, for example one synthesized chemically.

The term "nucleic acid fragment" as used herein refers to a nucleic acid sequence that has a deletion, e.g., a 5'-terminal or 3'-terminal deletion compared to a full-length reference nucleotide sequence. In an embodiment, the nucleic acid fragment is a contiguous sequence in which the nucleotide sequence of the fragment is identical to the corresponding positions in the naturally-occurring sequence. In some embodiments fragments are at least 10, 15, 20, or 25 nucleotides long, or at least 20, 30, 40, 50, 60, 70, 80, 90, 100, 110, 120, 130, 140, or 150 nucleotides long. In some embodiments a fragment of a nucleic acid sequence is a fragment of an open reading frame sequence. In some embodiments such a fragment encodes a polypeptide fragment (as defined herein) of the protein encoded by the open reading frame nucleotide sequence.

As used herein, an endogenous nucleic acid sequence in the genome of an organism (or the encoded protein product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous (originating from the same host cell or progeny thereof) or exogenous (originating from a different host cell or progeny thereof). By way of example, a promoter sequence can be substituted (e.g., by homologous recombination) for the native promoter of a gene in the genome of a host cell, such that this gene has an altered expression pattern. This gene would now become "recombinant" because it is separated from at least some of the sequences that naturally flank it.

A nucleic acid is also considered "recombinant" if it contains any modifications that do not naturally occur to the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

As used herein, the phrase "degenerate variant" of a reference nucleic acid sequence encompasses nucleic acid sequences that can be translated, according to the standard genetic code, to provide an amino acid sequence identical to that translated from the reference nucleic acid sequence. The term "degenerate oligonucleotide" or "degenerate primer" is used to signify an oligonucleotide capable of hybridizing with target nucleic acid sequences that are not necessarily identical in sequence but that are homologous to one another within one or more particular segments.

The term "percent sequence identity" or "identical" in the context of nucleic acid sequences refers to the residues in the two sequences which are the same when aligned for maximum correspondence. The length of sequence identity comparison may be over a stretch of at least about nine nucleotides, usually at least about 20 nucleotides, more usually at least about 24 nucleotides, typically at least about 28 nucleotides, more typically at least about 32, and even more typically at least about 36 or more nucleotides. There are a number of different algorithms known in the art which can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). For instance, percent sequence identity between nucleic acid sequences can be determined using FASTA with its default parameters (a word size of 6 and the NOPAM factor for the scoring matrix) or using Gap with its default parameters as provided in GCG Version 6.1, herein incorporated by reference. Alternatively, sequences can be compared using the computer program, BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the nucleotide bases, as measured by any well-known algorithm of sequence identity, such as FASTA, BLAST or Gap, as discussed above.

Alternatively, substantial homology or similarity exists when a nucleic acid or fragment thereof hybridizes to another nucleic acid, to a strand of another nucleic acid, or to the complementary strand thereof, under stringent hybridization conditions. "Stringent hybridization conditions" and "stringent wash conditions" in the context of nucleic acid hybridization experiments depend upon a number of different physical parameters. Nucleic acid hybridization will be affected by such conditions as salt concentration, temperature, solvents, the base composition of the hybridizing species, length of the complementary regions, and the number of nucleotide base mismatches between the hybridizing nucleic acids, as will be readily appreciated by those skilled in the art. One having ordinary skill in the art knows how to vary these parameters to achieve a particular stringency of hybridization.

In general, "stringent hybridization" is performed at about 25° C. below the thermal melting point (Tm) for the specific DNA hybrid under a particular set of conditions. "Stringent washing" is performed at temperatures about 5° C. lower than the Tm for the specific DNA hybrid under a particular set of conditions. The Tm is the temperature at which 50% of the target sequence hybridizes to a perfectly matched probe. See Sambrook et al., Molecular Cloning: A Laboratory Manual, 2d ed., Cold Spring Harbor Laboratory Press, Cold Spring Harbor, N.Y. (1989), page 9.51, hereby incorporated by reference. For purposes herein, "stringent conditions" are defined for solution phase hybridization as aqueous hybridization (i.e., free of formamide) in 6×SSC (where 20×SSC contains 3.0 M NaCl and 0.3 M sodium citrate), 1% SDS at 65° C. for 8-12 hours, followed by two washes in 0.2×SSC, 0.1% SDS at 65° C. for 20 minutes. It will be appreciated by the skilled worker that hybridization at 65° C. will occur at different rates depending on a number of factors including the length and percent identity of the sequences which are hybridizing.

As used herein, an "expression control sequence" refers to polynucleotide sequences which are necessary to affect the expression of coding sequences to which they are operatively linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to encompass, at a minimum, any component whose presence is essential for expression, and can also encompass an additional component whose presence is advantageous, for example, leader sequences and fusion partner sequences.

As used herein, "operatively linked" or "operably linked" expression control sequences refers to a linkage in which the expression control sequence is contiguous with the gene of interest to control the gene of interest, as well as expression control sequences that act in trans or at a distance to control the gene of interest.

As used herein, a "vector" is intended to refer to a nucleic acid molecule capable of transporting another nucleic acid to which it has been linked. One type of vector is a "plasmid,"

which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

The term "recombinant host cell" (or simply "recombinant cell" or "host cell"), as used herein, is intended to refer to a cell into which a recombinant nucleic acid such as a recombinant vector has been introduced. In some instances the word "cell" is replaced by a name specifying a type of cell. For example, a "recombinant microorganism" is a recombinant host cell that is a microorganism host cell and a "recombinant cyanobacteria" is a recombinant host cell that is a cyanobacteria host cell. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "recombinant host cell," "recombinant cell," and "host cell", as used herein. A recombinant host cell may be an isolated cell or cell line grown in culture or may be a cell which resides in a living tissue or organism.

As used herein, the term "heterotrophic" refers to an organism that cannot fix carbon and uses organic carbon for growth.

As used herein, the term "autotrophic" refers to an organism that produces complex organic compounds (such as carbohydrates, fats, and proteins) from simple inorganic molecules using energy from light (by photosynthesis) or inorganic chemical reactions (chemosynthesis).

As used herein, "muscle mass" refers to the weight of muscle in a subject's body. Muscle mass includes the skeletal muscles, smooth muscles (such as cardiac and digestive muscles) and the water contained in these muscles. Muscle mass of specific muscles can be determined using dual energy x-ray absorptiometry (DEXA) (Padden-Jones et al., 2004). Total lean body mass (minus the fat), total body mass, and bone mineral content can be measured by DEXA as well. In some embodiments a change in the muscle mass of a specific muscle of a subject is determined, for example by DEXA, and the change is used as a proxy for the total change in muscle mass of the subject. Thus, for example, if a subject consumes a nutritive protein as disclosed herein and experiences an increase over a period of time in muscle mass in a particular muscle or muscle group, it can be concluded that the subject has experienced an increase in muscle mass.

As used herein, a "muscle strength" refers to the amount of force a muscle can produce with a single maximal effort. There are two types of muscle strength, static strength and dynamic strength. Static strength refers to isometric contraction of a muscle, where a muscle generates force while the muscle length remains constant and/or when there is no movement in a joint. Examples include holding or carrying an object, or pushing against a wall. Dynamic strength refers to a muscle generating force that results in movement. Dynamic strength can be isotonic contraction, where the muscle shortens under a constant load or isokinetic contraction, where the muscle contracts and shortens at a constant speed. Dynamic strength can also include isoinertial strength.

Unless specified, "muscle strength" refers to maximum dynamic muscle strength. Maximum strength is referred to as "one repetition maximum" (1RM). This is a measurement of the greatest load (in kilograms) that can be fully moved (lifted, pushed or pulled) once without failure or injury. This value can be measured directly, but doing so requires that the weight is increased until the subject fails to carry out the activity to completion. Alternatively, 1RM is estimated by counting the maximum number of exercise repetitions a subject can make using a load that is less than the maximum amount the subject can move. Leg extension and leg flexion are often measured in clinical trials (Borsheim et al., "Effect of amino acid supplementation on muscle mass, strength and physical function in elderly," Clin Nutr 2008; 27:189-195; Paddon-Jones, et al., "Essential amino acid and carbohydrate supplementation ameliorates muscle protein loss in humans during 28 days bed rest," J Clin Endocrinol Metab 2004; 89:4351-4358).

As used herein, "functional performance" refers to a functional test that simulates daily activities. "Functional performance" is measured by any suitable accepted test, including timed-step test (step up and down from a 4 inch bench as fast as possible 5 times), timed floor transfer test (go from a standing position to a supine position on the floor and thereafter up to a standing position again as fast as possible for one repetition), and physical performance battery test (static balance test, chair test, and a walking test) (Borsheim et al., "Effect of amino acid supplementation on muscle mass, strength and physical function in elderly," Clin Nutr 2008; 27:189-195).

As used herein, a "body mass index" or "BMI" or "Quetelet index" is a subject's weight in kilograms divided by the square of the subject's height in meters ($kg/m^2$).

For adults, a frequent use of the BMI is to assess how much an individual's body weight departs from what is normal or desirable for a person of his or her height. The weight excess or deficiency may, in part, be accounted for by body fat, although other factors such as muscularity also affect BMI significantly. The World Health Organization regards a BMI of less than 18.5 as underweight and may indicate malnutrition, an eating disorder, or other health problems, while a BMI greater than 25 is considered overweight and above 30 is considered obese. (World Health Organization. BMI classification. Accessed Mar. 19, 2012 http://apps.who.int/bmi/index.jsp?introPage=intro_3.html.) As used herein a "desirable body mass index" is a body mass index of from about 18.5 to about 25. Thus, if a subject has a BMI below about 18.5, then an increase in the subject's BMI is an increase in the desirability of the subject's BMI. If instead a subject has a BMI above about 25, then a decrease in the subject's BMI is an increase in the desirability of the subject's BMI.

As used herein, an "elderly" mammal is one who experiences age related changes in at least one of body mass index and muscle mass (e.g., age related sarcopenia). In some embodiments an "elderly" human is at least 50 years old, at least 60 years old, at least 65 years old, at least 70 years old, at least 75 years old, at least 80 years old, at least 85 years old, at least 90 years old, at least 95 years old, or at least 100 years old. In some embodiments and an elderly animal, mammal, or human is a human who has experienced a loss of muscle mass from peak lifetime muscle mass of at least 5%, at least 10%, at least 15%, at least 20%, at least 25%, at least 30%, at least 35%, at least 40%, at least 45%, at least 50%, at least 55%, or at least 60%. Because age related changes to at least one of body mass index and muscle mass are known to correlate with increasing age, in some embodiments an elderly mammal is identified or defined simply on the basis of age. Thus, in some embodiments an "elderly" human is identified or defined simply by the fact that their age is at least 60 years old, at least 65 years old, at least 70 years old, at least 75 years old, at least 80 years old, at least 85 years old, at least 90 years old, at least 95 years old, or at least 100 years old, and without recourse to a measurement of at least one of body mass index and muscle mass.

As used herein, a patient is "critically-medically ill" if the patient, because of medical illness, experiences changes in at least one of body mass index and muscle mass (e.g., sarcopenia). In some embodiments the patient is confined to bed for at least 25%, at least 50%, at least 60%, at least 70%, at least 80%, at least 90%, at least 95%, or 100% of their waking time. In some embodiments the patient is unconscious. In some embodiments the patient has been confined to bed as described in this paragraph for at least 1 day, 2 days, 3 days, 4 days, 5 days, 10 days, 2 weeks, 3 weeks, 4 weeks, 5 weeks, 10 weeks or longer.

As used herein, "protein-energy malnutrition" refers to a form of malnutrition where there is inadequate protein intake. Types include Kwashiorkor (protein malnutrition predominant), Marasmus (deficiency in both calorie and protein nutrition), and Marasmic Kwashiorkor (marked protein deficiency and marked calorie insufficiency signs present, sometimes referred to as the most severe form of malnutrition).

As used herein, "cachexia" refers to a multifaceted clinical syndrome that results in wasting and weight loss. It is a complex condition where protein catabolism exceeds protein anabolism, which makes muscle wasting a primary feature of the condition. In addition to the metabolic derangements in protein metabolism, it is also characterized by anorexia and inflammation. These derangements plus impaired protein metabolism are responsive to nutrition therapy to varying degrees.

As used herein, "thermogenesis" is the process of heat production in a mammal. Thermogenesis is accompanied by an increase in energy expenditure. Thermogenesis is specifically the energy burned following the metabolism of a food component (such as protein). This may also be referred to as the thermic effect of food. Total energy expenditure by an individual equals the sum of resting energy expenditure (energy consumed at rest in a fasting state to support basal metabolism), the thermic effect of food, and energy expenditure related to physical activity. Resting energy expenditure accounts for about 65-75% of total energy expenditure in humans. The amount and activity of muscle mass is one influencer of resting energy expenditure. Adequate protein consumption to support muscle also influences resting energy expenditure. The ingestion of protein tends to increase energy expenditure following a meal; this is the thermic effect of food. The thermic effect of food accounts for about 10% of total energy expenditure in humans. While this is a small proportion of total energy expenditure, small increases in this value can impact body weight. Protein has a higher thermic effect than fat or carbohydrate; this effect along with other metabolic influences of protein make it a useful substrate for weight control, diabetes management and other conditions.

As used herein, "satiation" is the act of becoming full while eating or a reduced desire to eat. This halts or diminishes eating.

As used herein, "satiety" is the act of remaining full after a meal which manifests as the period of no eating follow the meal.

As used herein, "exercise" is, most broadly, any bodily activity that enhances or maintains physical fitness and overall health and wellness. Exercise is performed for various reasons including strengthening muscles and the cardiovascular system, honing athletic skills, weight loss or maintenance, as well as for the purpose of enjoyment.

As used herein, a "sufficient amount" is an amount of a protein or polypeptide disclosed herein that is sufficient to cause a desired effect. For example, if an increase in muscle mass is desired, a sufficient amount is an amount that causes an increase in muscle mass in a subject over a period of time. A sufficient amount of a protein or polypeptide fragment can be provided directly, i.e., by administering the protein or polypeptide fragment to a subject, or it can be provided as part of a composition comprising the protein or polypeptide fragment. Modes of administration are discussed elsewhere herein.

As used herein, the term "mammal" refers to any member of the taxonomic class mammalia, including placental mammals and marsupial mammals. Thus, "mammal" includes humans, primates, livestock, and laboratory mammals. Exemplary mammals include a rodent, a mouse, a rat, a rabbit, a dog, a cat, a sheep, a horse, a goat, a llama, cattle, a primate, a pig, and any other mammal. In some embodiments, the mammal is at least one of a transgenic mammal, a genetically-engineered mammal, and a cloned mammal.

A. Nutritive Proteins

For the purposes of this disclosure, a "nutritive protein" is a protein that contains a desirable amount of essential amino acids. In some embodiments, the nutritive protein comprises at least 30% essential amino acids by weight. In some embodiments, the nutritive protein comprises at least 40% essential amino acids by weight. In some embodiments, the nutritive protein comprises at least 50% essential amino acids by weight. In some embodiments the nutritive protein comprises or consists of a protein or fragment of a protein that naturally occurs in an edible species. In its broadest sense, an "edible species" encompasses any species known to be eaten without deleterious effect by at least one type of mammal. A deleterious effect includes a poisonous effect and a toxic effect. In some embodiments an edible species is a species known to be eaten by humans without deleterious effect. Some edible species are an infrequent but known component of the diet of only a small group of a type of mammal in a limited geographic location while others are a dietary staple throughout much of the world. In other embodiments an edible species is one not known to be previously eaten by any mammal, but that is demonstrated to be edible upon testing. Edible species include but are not limited to *Gossypium turneri, Pleurotus cornucopiae, Glycine max, Oryza sativa, Thunnus obesus, Abies bracteata, Acomys ignitus, Lathyrus aphaca, Bos gaurus, Raphicerus melanotis, Phoca groenlandica, Acipenser sinensis, Viverra tangalunga, Pleurotus sajor-caju, Fagopyrum tataricum, Pinus strobus, Ipomoea nil, Taxus cuspidata, Ipomoea* wrightii, Mya arenaria, Actinidia deliciosa, Gazella granti, Populus tremula, Prunus domestica, Larus argentatus, Vicia villosa, Sargocentron punctatissimum, Silene latifolia, Lagenodelphis hosei, Spisula solidissima, Crossarchus obscurus, Phaseolus angularis, Lathyrus vestitus, Oncorhynchus gorbuscha, Alligator mississippiensis, Pinus halepensis, Larus canus, Brassica napus, Silene cucubalus, Phoca fasciata, Gazella bennettii, Pinus taeda, Taxus canadensis, Zamia furfuracea, Pinus yunnanensis, Pinus wallichiana, Asparagus officinalis, Capsicum baccatum, Pinus longaeva, Taxus baccata, Pinus sibirica, Citrus sinensis, Sargocentron xantherythrum, Bison bison, Gazella thomsonii, Vicia sativa, Branta canadensis, Apium graveolens, Acer campestre, Coriandrum sativum, Silene conica, Lactuca sativa, Capsicum chinense, Abies veitchii, Capra hircus, Gazella spekei, Oncorhynchus keta, Ipomoea obscura, Cucumis melo var. conomon, Phoca hispida, Vulpes vulpes, Ipomoea quamoclit, Solanum habrochaites, Populus sp., Pinus rigida, Quercus lyrata, Phaseolus coccineus, Larus ridibundus, Sargocentron spiniferum, Thunnus thynnus, Vulpes lagopus, Bos gaurus frontalis, Acer opalus, Acer palmatum, Quercus ilex, Pinus mugo, Grus antigone, Pinus uncinata, Prunus mume, Oncorhynchus tschawytscha, Gazella subgutturosa, Vulpes zerda, Pinus coulteri, Gossypium barbadense, Acer pseudoplatanus, Oncorhynchus nerka, Sus barbatus, Fagopyrum esculentum subsp. Ancestrale, Cynara cardunculus, Phaseolus aureus, Populus nigra, Gossypium schwendimanii, Solanum chacoense, Quercus rubra, Cucumis sativus, Equus burchelli, Oncorhynchus kisutch, Pinus radiata, Phoca vitulina richardsi, Grus nigricollis, Abies grandis, Oncorhynchus masou, Spinacia oleracea, Solanum chilense, Addax nasomaculatus, Ipomoea batatas, Equus grevyi, Abies sachalinensis, Pinus pinea, Hipposideros commersoni, Crocus nudiflorus, Citrus maxima, Acipenser transmontanus, Gossypium gossypioides, Viverra zibetha, Quercus cerris, Anser indicus, Pinus balfouriana, Silene otites, Oncorhynchus sp., Viverra megaspila, Bos mutus grunniens, Pinus elliottii, Equus hemionus kulan, Capra ibex ibex, Allium sativum, Raphanus sativus, Pinus echinata, Prunus serotina, Sargocentron diadema, Silene gallica, Brassica oleracea, Daucus carota, Oncorhynchus mykiss, Brassica oleracea var. alboglabra, Gossypium hirsutum, Abies alba, Citrus reticulata, Cichorium intybus, Bos sauveli, Lama glama, Zea mays, Acorus gramineus, Vulpes macrotis, Ovis ammon darwini, Raphicerus sharpei, Pinus contorta, Bos indicus, Capra sibirica, Pinus ponderosa, Prunus dulcis, Solanum sogarandinum, Ipomoea aquatica, Lagenorhynchus albirostris, Ovis canadensis, Prunus avium, Gazella dama, Thunnus alalunga, Silene pratensis, Pinus cembra, Crocus sativus, Citrullus lanatus, Gazella rufifrons, Brassica tournefortii, Caprafalconeri, Bubalus mindorensis, Pinus palustris, Prunus laurocerasus, Grus vipio, Ipomoea purpurea, Pinus leiophylla, Lagenorhynchus obscurus, Raphicerus campestris, Brassica rapa subsp. Pekinensis, Acmella radicans, Ipomoea triloba, Pinus patula, Cucumis melo, Pinus virginiana, Solanum lycopersicum, Pinus densiflora, Pinus engelmannii, Quercus robur, Ipomoea setosa, Pleurotus djamor, Hipposideros diadema, Ovis aries, Sargocentron microstoma, Brassica oleracea var. italica, Capra cylindricornis, Populus kitakamiensis, Allium textile, Vicia faba, Fagopyrum esculentum, Bison priscus, Quercus suber, Lagophylla ramosissima, Acrantophis madagascariensis, Acipenser baerii, Capsicum annuum, Triticum aestivum, Xenopus laevis, Phoca sibirica, Acipenser naccarii, Actinidia chinensis, Ovis dalli, Solanum tuberosum, Bubalus carabanensis, Citrus jambhiri, Bison bonasus, Equus asinus, Bubalus depressicornis, Pleurotus eryngii, Solanum demissum, Ovis vignei, Zea mays subsp. Parviglumis, Lathyrus tingitanus, Welwitschia mirabilis, Grus rubicunda, Ipomoea coccinea, Allium cepa, Gazella soemmerringii, Brassica rapa, Lama vicugna, Solanum peruvianum, Xenopus borealis, Capra caucasica, Thunnus albacares, Equus zebra, Gallus gallus, Solanum bulbocastanum, Hipposideros terasensis, Lagenorhynchus acutus, Hippopotamus amphibius, Pinus koraiensis, Acer monspessulanum, Populus deltoides, Populus trichocarpa, Acipenser guldenstadti, Pinus thunbergii, Brassica oleracea var. capitata, Abyssocottus korotneffi, Gazella cuvieri, Abies homolepis, Abies holophylla, Gazella gazella, Pinus parviflora, Brassica oleracea var. acephala, Cucurbita pepo, Pinus armandii, Abies mariesii, Thunnus thynnus orientalis, Citrus unshiu, Solanum cheesmanii, Lagenorhynchus obliquidens, Acer platanoides, Citrus limon, Acrantophis dumerili, Solanum commersonii, Gossypium arboreum, Prunus persica, Pleurotus ostreatus, Abies firma, Gazella leptoceros, Salmo salar, Homarus americanus, Abies magnifica, Bos javanicus, Phoca largha, Sus cebifrons, Solanum melongena, Phoca vitulina, Pinus sylvestris, Zamiafloridana, Vulpes corsac, Allium porrum, Phoca caspica, Vulpes chama, Taxus chinensis, Brassica oleracea var. botrytis, Anser anser anser, Phaseolus lunatus, Brassica campestris, Acer saccharum, Pinus pumila, Solanum pennellii, Pinus edulis, Ipomoea cordatotriloba, Populus alba, Oncorhynchus clarki, Quercus petraea, Sus verrucosus, Equus caballus przewalskii, Populus euphratica, Xenopus tropicalis, Taxus brevifolia, Lama guanicoe, Pinus banksiana, Solanum nigrum, Sus celebensis, Brassica juncea, Lagenorhynchus cruciger, Populus tremuloides, Pinus pungens, Bubalus quarlesi, Quercus gamelliflora, Ovis orientalis musimon, Bubalus bubalis, Pinus luchuensis, Sus philippensis, Phaseolus vulgaris, Salmo trutta, Acipenser persicus, Solanum brevidens, Pinus resinosa, Hippotragus niger, Capra nubiana, Asparagus scaber, Ipomoea platensis, Sus scrofa, Capra aegagrus, Lathyrus sativus, Sargocentron tiere, Hippoglossus hippoglossus, Acorus americanus, Equus caballus, Bos taurus, Barbarea vulgaris, Lama guanicoe pacos, Pinus pinaster, Octopus vulgaris, Solanum crispum, Hippotragus equinus, Equus burchellii antiquorum, Crossarchus alexandri, Ipomoea alba, Triticum monococcum, Populusjackii, Lagenorhynchus australis, Gazella dorcas, Quercus coccifera, Anser caerulescens, Acorus calamus, Pinus roxburghii, Pinus tabuliformis, Zamia fischeri, Grus carunculatus, Acomys cahirinus, Cucumis melo var. reticulatus, Gallus lafayettei, Pisum sativum, Pinus attenuata, Pinus clausa, Gazella saudiya, Capra ibex, Ipomoea trifida, Zea luxurians, Pinus krempfii, Acomys wilsoni, Petroselinum crispum, Quercus palustris, Triticum timopheevi, Meleagris gallopavo, Brassica oleracea, Brassica oleracea, Beta vulgaris, Solanum lycopersicum, Phaseolus vulgaris, Xiphias gladius, Morone saxatilis, Micropterus salmoides, Placopecten magellanicus, Sprattus sprattus, Clupea harengus, Engraulis encrasicolus, Cucurbita maxima, Agaricus bisporus, Musa acuminata×balbisiana, Malus domestica, Cicer arietinum, Anas platyrhynchos, Vaccinium macrocarpum, Rubus idaeus× strigosus, Vaccinium angustifolium, Fragaria ananassa, Rubus fruticosus, Cucumis melo, Ananas comosus, Cucurbita pepo, Cucurbita moschata, Sus scrofa domesticus, Ocimum basilicum, Rosmarinus officinalis, Foeniculum vulgare, Rheum rhabarbarum, Carica papaya, Mangifera indica, Actinidia deliciosa, Prunus armeniaca, Prunus avium, Cocos nucifera, Olea europaea, Pyrus communis, Ficus carica, Passiflora edulis, Oryza sativa subsp. *Japonica*, *Oryza sativa* subsp. *Indica*, *Coturnix coturnix*, *Saccharomyces cerevisiae*.

In some embodiments the nutritive protein comprises or consists of a derivative or mutein of a protein or fragment of a protein that naturally occurs in an edible species. Such a nutritive protein may be referred to as an "engineered nutritive protein." In such embodiments the natural protein or fragment thereof is a "reference" protein or polypeptide and the engineered nutritive protein or a first polypeptide sequence thereof comprises at least one sequence modification relative to the amino acid sequence of the reference protein or polypeptide. For example, in some embodiments the engineered nutritive protein or first polypeptide sequence thereof is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one reference nutritive protein amino acid sequence. Typically the ratio of at least one of branch chain amino acid residues to total amino acid residues, essential amino acid residues to total amino acid residues, and leucine residues to total amino acid residues, present in the engineered nutritive protein or a first polypeptide sequence thereof is greater than the corresponding ratio of at least one of branch chain amino acid residues to total amino acid residues, essential amino acid residues to total amino acid residues, and leucine residues to total amino acid residues present in the reference nutritive protein or polypeptide sequence.

In some embodiments the nutritive protein is an abundant protein in food or a derivative or mutein thereof, or is a fragment of an abundant protein in food or a derivative or mutein thereof. An abundant protein is a protein that is present in a higher concentration in a food relative to other proteins present in the food. The food can be a known component of the diet of only a small group of a type of mammal in a limited geographic location, or a dietary staple throughout much of the world. In some embodiments the abundant protein in food is selected from chicken egg proteins such as ovalbumin, ovotransferrin, and ovomucuoid; meat proteins such as myosin, actin, tropomyosin, collagen, and troponin; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1,6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Three natural sources of protein generally regarded as good sources of high quality amino acids are whey protein, egg protein, and soy protein. Each source comprises 5 multiple proteins. Table 1 presents the weight proportional representation of each amino acid in the protein source (g AA/g protein) expressed as a percentage.

TABLE 1

| Amino Acid | Whey | Egg | Soy |
|---|---|---|---|
| Isoleucine | 6.5% | 5.5% | 5.0% |
| Leucine | 11.0% | 8.6% | 8.0% |
| Lysine | 9.1% | 7.2% | 6.3% |
| Methionine | 2.1% | 3.1% | 1.3% |
| Phenylalanine | 3.4% | 5.3% | 1.2% |
| Threonine | 7.0% | 4.8% | 3.7% |
| Tryptophan | 1.7% | 1.2% | 1.3% |
| Valine | 6.2% | 6.1% | 4.9% |
| Histidine | 2.0% | 2.4% | 2.7% |
| Other | 51.7% | 49.5% | 60.4% |

Table 2 presents the weight proportion of each protein source that is essential amino acids, branched chain amino acids (L, I, and V), and leucine (L) (alone).

TABLE 2

| Protein Source | Essential Amino Acids | Branch Chain Amino Acids | Leucine |
|---|---|---|---|
| Whey | 49.0% | 23.7% | 11.0% |
| Egg | 50.5% | 20.1% | 8.6% |
| Soy | 39.6% | 17.9% | 8.0% |

The sources relied on to determine the amino acid content of Whey are: Belitz H D., Grosch W., and Schieberle P. Food Chemistry (4th Ed). Springer-Verlag, Berlin Heidelberg 2009; http://www.gnc.com/product/index.jsp?productId=2986027; http://www.nutrabio.com/Products/whey_protein_concentrate.htm; and http://nutrabio.com/Products/whey_protein_isolate.htm. The amino acid content values from those sources were averaged to give the numbers presented in Tables 1 and 2. The source for soy protein is Egg, National Nutrient Database for Standard Reference, Release 24 (http://ndb.nal.usda.gov/ndb/foods/list). The source for soy protein is Self Nutrition Data (http://nutritiondata.self.com/facts/legumes-and-legume-products/4389/2).

As used herein, "whey protein" or "whey" means a protein mixture comprising an amino acid composition according to Tables 1 and 2. As used herein, whey protein comprises 49% essential amino acids, 24% branch chain amino acids, and 11% leucine, by weight.

As used herein, "egg protein" or "egg" means a protein mixture comprising an amino acid composition according to Tables 1 and 2. As used herein, egg protein comprises 51% essential amino acids, 20% branch chain amino acids, and 9% leucine, by weight.

As used herein, "soy protein" or "soy" means a protein mixture comprising an amino acid composition according to Tables 1 and 2. As used herein, soy protein comprises 40% essential amino acids, 18% branch chain amino acids, and 8% leucine, by weight.

In some instances herein the portion of amino acid(s) of a particular type within a polypeptide, protein or a composition is quantified based on the weight ratio of the type of amino acid(s) to the total weight of amino acids present in the polypeptide, protein or composition in question. This value is calculated by dividing the weight of the particular amino acid(s) in the polypeptide, protein or a composition by the weight of all amino acids present in the polypeptide, protein or a composition.

In other instances the ratio of a particular type of amino acid(s) residues present in a polypeptide or protein to the total number of amino acids present in the polypeptide or protein in question is used. This value is calculated by dividing the number of the amino acid(s) in question that is present in each molecule of the polypeptide or protein by the total number of amino acid residues present in each molecule of the polypeptide or protein. A skilled artisan appreciates that these two methods are interchangeable and that the weight proportion of a type of amino acid(s) present in a polypeptide or protein can be converted to a ratio of the particular type of amino acid residue(s), and vice versa.

In certain embodiments herein the weight proportion of branched chain amino acids, leucine, and/or essential amino acids in whey, egg, or soy is used as a benchmark to measure the amino acid composition of a polypeptide, a protein, or a composition comprising at least one of a polypeptide and a protein. In those embodiments it is understood that the two measures are not completely equivalent, but it is also understood that the measures result in measurements that are similar enough to use for this purpose. For example, when a protein of interest is characterized as comprising a ratio of branch chain amino acid residues to total amino acid residues that is equal to or greater than 24% (the weight proportion of branch chain amino acid residues present in whey), that is a precise description of the branch chain amino acid content of the protein. At the same time, the weight proportion of branch chain amino acid residues present in that protein is not necessarily exactly equal to 24%. Even so, the skilled artisan understands that this is a useful comparison. If provided with the total number of amino acid residues present in the protein of interest the skilled artisan can also determine the weight proportion of branch chain amino acid residues in the protein of interest.

In some embodiments herein a fragment of a naturally-occurring nutritive protein is selected and optionally isolated. In some embodiments the fragment comprises at least 25 amino acids. In some embodiments the fragment comprises at least 50 amino acids. In some embodiments the fragment consists of at least 25 amino acids. In some embodiments the fragment consists of at least 50 amino acids. In some embodiments an isolated recombinant nutritive protein is provided. In some embodiments the nutritive protein comprises a first polypeptide sequence, and the first polypeptide sequence comprises a fragment of at least 25 or at least 50 amino acids of a naturally-occurring nutritive protein. In some embodiments the nutritive proteins is isolated. In some embodiments the nutritive proteins are recombinant. In some embodiments the nutritive proteins comprise a first polypeptide sequence comprising a fragment of at least 50 amino acids of a naturally-occurring nutritive protein. In some embodiments the nutritive proteins are isolated recombinant nutritive proteins. In some embodiments the isolated recombinant nutritive proteins disclosed herein are provided in a non-isolated and/or non-recombinant form In some embodiments a nutritive protein according to this disclosure comprises a first polypeptide sequence comprising a fragment of a naturally-occurring nutritive protein. In some embodiments of the nutritive protein, the nutritive protein consists of the first polypeptide sequence. In some embodiments of the nutritive protein, the nutritive protein consists of the fragment of a naturally-occurring nutritive protein.

In some embodiments a nutritive protein according to this disclosure comprises a first polypeptide sequence that comprises ratio of branch chain amino acid residues to total amino acid residues that is equal to or greater than the ratio of branch chain amino acid residues to total amino acid residues present in at least one of whey protein, egg protein, and soy protein. Thus, in such embodiments the nutritive protein comprises a first polypeptide sequence that comprises a ratio of branch chain amino acid residues to total amino acid residues that is equal to or greater than a ratio selected from 24%, 20%, and 18%.

In some embodiments a nutritive protein according to this disclosure comprises a first polypeptide sequence that comprises a ratio of L residues to total amino acid residues that is equal to or greater than the ratio of L residues to total amino acid residues present in at least one of whey protein, egg protein, and soy protein. Thus, in such embodiments the nutritive protein comprises a first polypeptide sequence that comprises a ratio of L residues to total amino acid residues that is equal to or greater than a ratio selected from 11%, 9%, and 8%.

In some embodiments a nutritive protein according to this disclosure comprises a first polypeptide sequence that comprises a ratio of essential amino acid residues to total amino acid residues that is equal to or greater than the ratio of essential amino acid residues to total amino acid residues present in at least one of whey protein, egg protein, and soy protein. Thus, in such embodiments the nutritive protein comprises a first polypeptide sequence that comprises a ratio of essential amino acid residues to total amino acid residues that is equal to or greater than a ratio selected from 49%, 51%, and 40%.

In some embodiments the nutritive protein comprises a first polypeptide sequence that comprises a ratio of branch chain amino acid residues to total amino acid residues that is equal to or greater than the ratio of branch chain amino acid residues to total amino acid residues present in at least one of whey protein, egg protein, and soy protein; and comprises a first polypeptide sequence that comprises a ratio of L residues to total amino acid residues that is equal to or greater than the ratio of L residues to total amino acid residues present in at least one of whey protein, egg protein, and soy protein. In some such embodiments the nutritive protein further comprises a first polypeptide sequence that comprises a ratio of essential amino acid residues to total amino acid residues that is equal to or greater than the ratio of essential amino acid residues to total amino acid residues present in at least one of whey protein, egg protein, and soy protein.

In some embodiments the nutritive protein comprises a first polypeptide sequence that comprises a ratio of branch chain amino acid residues to total amino acid residues equal to or greater than 24% and a ratio of L residues to total amino acid residues that is equal to or greater than 11%. In some such embodiments the nutritive protein further comprises a first polypeptide sequence that comprises a ratio of essential amino acid residues to total amino acid residues equal to or greater than 49%.

In some embodiments the nutritive protein comprises a first polypeptide sequence that comprises a ratio of branch chain amino acid residues to total amino acid residues equal to or greater than 20% and a ratio of L residues to total amino acid residues that is equal to or greater than 9%. In some such embodiments the nutritive protein further comprises a first polypeptide sequence that comprises a ratio of essential amino acid residues to total amino acid residues equal to or greater than 51%.

In some embodiments the nutritive protein comprises a first polypeptide sequence that comprises a ratio of branch chain amino acid residues to total amino acid residues equal to or greater than 18% and a ratio of L residues to total amino acid residues that is equal to or greater than 8%. In some such embodiments the nutritive protein further comprises a first polypeptide sequence that comprises a ratio of essential amino acid residues to total amino acid residues equal to or greater than 40%.

In some embodiments the nutritive protein comprises a first polypeptide sequence that comprises a ratio of branch chain amino acid residues to total amino acid residues that is equal to or greater than the ratio of branch chain amino acid residues to total amino acid residues present in at least one of whey protein, egg protein, and soy protein; and comprises a first polypeptide sequence that comprises a ratio of essential amino acid residues to total amino acid residues that is equal to or greater than the ratio of essential amino acid residues to total amino acid residues present in at least one of whey protein, egg protein, and soy protein. In some embodiments the nutritive protein comprises a first polypeptide sequence that comprises a ratio of branch chain amino acid residues to total amino acid residues equal to or greater than 24% and a ratio of essential amino acid residues to total amino acid residues that is equal to or greater than 49%. In some embodiments the nutritive protein comprises a first polypeptide sequence that comprises a ratio of branch chain amino acid residues to total amino acid residues equal to or greater than 20% and a ratio of essential amino acid residues to total amino acid residues that is equal to or greater than 51%. In some embodiments the nutritive protein comprises a first polypeptide sequence that comprises a ratio of branch chain amino acid residues to total amino acid residues equal to or greater than 18% and a ratio of essential amino acid residues to total amino acid residues that is equal to or greater than 40%.

In some embodiments the nutritive protein comprises a first polypeptide sequence that comprises a ratio of L residues to total amino acid residues that is equal to or greater than the ratio of L residues to total amino acid residues present in at least one of whey protein, egg protein, and soy protein; and comprises a first polypeptide sequence that comprises a ratio of essential amino acid residues to total amino acid residues that is equal to or greater than the ratio of essential amino acid residues to total amino acid residues present in at least one of whey protein, egg protein, and soy protein. In some embodiments the nutritive protein comprises a first polypeptide sequence that comprises a ratio of L residues to total amino acid residues equal to or greater than 11% and a ratio of essential amino acid residues to total amino acid residues that is equal to or greater than 49%. In some embodiments the nutritive protein comprises a first polypeptide sequence that comprises a ratio of L amino acid residues to total amino acid residues equal to or greater than 9% and a ratio of essential amino acid residues to total amino acid residues that is equal to or greater than 51%. In some embodiments the nutritive protein comprises a first polypeptide sequence that comprises a ratio of L amino acid residues to total amino acid residues equal to or greater than 8% and a ratio of essential amino acid residues to total amino acid residues that is equal to or greater than 40%.

In some embodiments of the nutritive protein, the first polypeptide sequence comprises a first polypeptide sequence comprising a ratio of branch chain amino acid residues to total amino acid residues equal to or greater than 24%, a ratio of L residues to total amino acid residues that is equal to or greater than 11%, a ratio of essential amino acid residues to total amino acid residues equal to or greater than 49%, and comprises at least one of every essential amino acid, and the first polypeptide sequence is selected from SEQ ID NO: 1 to SEQ ID NO: 1000. In some embodiments the first polypeptide sequence is selected from a modified derivative of SEQ ID NO: 1 to SEQ ID NO: 1000. In some embodiments the first polypeptide sequence is selected from a mutein of SEQ ID NO: 1 to SEQ ID NO: 1000.

In some embodiments of the nutritive protein, the first polypeptide sequence comprises a first polypeptide sequence comprising a ratio of branch chain amino acid residues to total amino acid residues equal to or greater than 24%, a ratio of L residues to total amino acid residues that is equal to or greater than 11%, and a ratio of essential amino acid residues to total amino acid residues equal to or greater than 49%, and the first polypeptide sequence is selected from SEQ ID NO: 1001 to SEQ ID NO: 1414. In some embodiments the first polypeptide sequence is selected from a modified derivative of SEQ ID NO: 1001 to SEQ ID NO: 1414. In some embodiments the first polypeptide sequence is selected from a mutein of SEQ ID NO: 1001 to SEQ ID NO: 1414.

In some embodiments of the nutritive protein, the first polypeptide sequence comprises a first polypeptide sequence comprising a ratio of branch chain amino acid residues to total amino acid residues equal to or greater than 24%, a ratio of essential amino acid residues to total amino acid residues equal to or greater than 49%, and comprises at least one of every essential amino acid, and the first polypeptide sequence is selected from SEQ ID NO: 1415 to SEQ ID NO: 1899. In some embodiments the first polypeptide sequence is selected from a modified derivative of SEQ ID NO: 1415 to SEQ ID NO: 1899. In some embodiments the first polypeptide sequence is selected from a mutein of SEQ ID NO: 1415 to SEQ ID NO: 1899.

In some embodiments of the nutritive protein, the first polypeptide sequence comprises a first polypeptide sequence comprising a ratio of essential amino acid residues to total amino acid residues equal to or greater than 49% and a ratio of L residues to total amino acid residues that is equal to or greater than 11%, and comprises at least one of every essential amino acid, and the first polypeptide sequence is selected from SEQ ID NO: 1900 to SEQ ID NO: 2102. In some embodiments the first polypeptide sequence is selected from a modified derivative of SEQ ID NO: 1900 to SEQ ID NO: 2102. In some embodiments the first polypeptide sequence is selected from a mutein of SEQ ID NO: 1900 to SEQ ID NO: 2102.

In some embodiments of the nutritive protein, the first polypeptide sequence comprises a first polypeptide sequence comprising a ratio of branch chain amino acid residues to total amino acid residues equal to or greater than 24% and a ratio of L amino acid residues to total amino acid residues that is equal to or greater than 11%, and comprises at least one of every essential amino acid, and the first polypeptide sequence is selected from SEQ ID NO: 2103 to SEQ ID NO: 2518. In some embodiments the first polypeptide sequence is selected from a modified derivative of SEQ ID NO: 2103 to SEQ ID NO: 2518. In some embodiments the first polypeptide sequence is selected from a mutein of SEQ ID NO: 2103 to SEQ ID NO: 2518.

In some embodiments of the nutritive protein, the first polypeptide sequence comprises a first polypeptide sequence comprising a ratio of branch chain amino acid residues to total amino acid residues equal to or greater than 24%, a ratio of L residues to total amino acid residues that is equal to or greater than 11%, and comprises at least one of every essential amino acid.

In some embodiments of the nutritive protein, the first polypeptide sequence comprises a first polypeptide sequence comprising a ratio of branch chain amino acid residues to total amino acid residues equal to or greater than 24% and a ratio of essential amino acid residues to total amino acid residues equal to or greater than 49%.

In some embodiments of the nutritive protein, the first polypeptide sequence comprises a first polypeptide sequence comprising a ratio of L residues to total amino acid residues that is equal to or greater than 11% and a ratio of essential amino acid residues to total amino acid residues equal to or greater than 49%.

In some embodiments of the nutritive protein, the first polypeptide sequence comprises a first polypeptide sequence comprising a ratio of essential amino acid residues to total amino acid residues equal to or greater than 49% and comprises at least one of every essential amino acid.

In some embodiments of the nutritive protein, the first polypeptide sequence comprises a first polypeptide sequence comprising a ratio of branch chain amino acid residues to total amino acid residues equal to or greater than 24% and comprises at least one of every essential amino acid.

In some embodiments of the nutritive protein, the first polypeptide sequence comprises a first polypeptide sequence comprising a ratio of L residues to total amino acid residues that is equal to or greater than 11% and comprises at least one of every essential amino acid.

In some embodiments of the nutritive protein, the first polypeptide sequence comprises a first polypeptide sequence comprising a ratio of L residues to total amino acid residues that is equal to or greater than 11%.

In some embodiments of the nutritive protein, the nutritive protein further comprises a second polypeptide sequence. In some embodiments the second polypeptide sequence consists of from 3 to 10, 5 to 20, 10 to 30, 20 to 50, 25 to 75, 50 to 100 or 100 to 200 amino acids. In some embodiments the second polypeptide sequence is not derived from a naturally-occurring nutritive protein. In some embodiments the second polypeptide sequence is selected from a tag for affinity purification, a protein domain linker, and a protease recognition site. In some embodiments the tag for affinity purification is a polyhistidine-tag. In some embodiments the protein domain linker comprises at least one copy of the sequence GGSG. In some embodiments the protease is selected from pepsin, trypsin, and chymotrypsin.

In some embodiments the recombinant nutritive protein consists of the first polypeptide sequence and the second polypeptide sequence.

In some embodiments the nutritive protein further comprises a third polypeptide sequence comprising a fragment of at least 25 or at least 50 amino acids of a naturally-occurring nutritive protein. In some embodiments the first and third polypeptide sequences are the same. In some embodiments the first and third polypeptide sequences are different. In some embodiments the first and third polypeptide sequences are derived from the same naturally-occurring nutritive protein. In some embodiments the order of the first and third polypeptide sequences in the isolated recombinant nutritive protein is the same as the order of the first and third polypeptide sequences in the naturally-occurring nutritive protein. In some embodiments the order of the first and third polypeptide sequences in the nutritive protein is different than the order of the first and third polypeptide sequences in the naturally-occurring nutritive protein. In some embodiments the first and third polypeptide sequences are derived from different naturally-occurring nutritive proteins. In some embodiments the second polypeptide sequence is flanked by the first and third polypeptide sequences.

In some embodiments of the nutritive protein, the first and/or third polypeptide sequence comprises a fragment of a naturally-occurring nutritive protein and the ratio of branch chain amino acid residues to total amino acid residues present in the first and/or third polypeptide sequence is equal to or greater than the ratio of branch chain amino acid residues to total amino acid residues present in at least one of whey protein, egg protein, and soy protein.

In some embodiments of the nutritive protein, the first and/or third polypeptide sequence comprises a first and/or third polypeptide sequence comprising a fragment of a naturally-occurring nutritive protein and the ratio of L residues to total amino acid residues present in the first and/or third polypeptide sequence is equal to or greater than the ratio of L residues to total amino acid residues present in at least one of whey protein, egg protein, and soy protein.

In some embodiments of the nutritive protein, the first and/or third polypeptide sequence comprises a first and/or third polypeptide sequence comprising a fragment of a naturally-occurring nutritive protein and the ratio of essential amino acid residues to total amino acid residues present in the first and/or third polypeptide sequence is equal to or greater than the ratio of essential amino acid residues to total amino acid residues present in at least one of whey protein, egg protein, and soy protein.

In some embodiments of the nutritive protein, the first and/or third polypeptide sequence comprises a first and/or third polypeptide sequence comprising a fragment of a naturally-occurring nutritive protein and the ratio of branch chain amino acid residues to total amino acid residues present in the first and/or third polypeptide sequence is equal to or greater than the ratio of branch chain amino acid residues to total amino acid residues present in at least one of whey protein, egg protein, and soy protein; and the first and/or third polypeptide sequence comprises a ratio of L residues to total amino acid residues that is equal to or greater than the ratio of L residues to total amino acid residues present in at least one of whey protein, egg protein, and soy protein. In some such embodiments the first and/or third polypeptide sequence further comprises a ratio of essential amino acid residues to total amino acid residues that is equal to or greater than the ratio of essential amino acid residues to total amino acid residues present in at least one of whey protein, egg protein, and soy protein.

In some embodiments of the nutritive protein, the first and/or third polypeptide sequence comprises a first and/or third polypeptide sequence comprising a ratio of branch chain amino acid residues to total amino acid residues equal to or greater than 24% and a ratio of L residues to total amino acid residues that is equal to or greater than 11%. In some such embodiments the first and/or third polypeptide sequence further comprises a ratio of essential amino acid residues to total amino acid residues equal to or greater than 49%.

In some embodiments the naturally-occurring nutritive protein from which a fragment is derived is a nutritive protein other than at least one nutritive protein selected from egg proteins such as ovalbumin, ovotransferrin, and ovomucuoid; meat proteins such as myosin, actin, tropomyosin, collagen, and troponin; milk proteins such as whey and casein; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1,6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Phenylketonuria (PKU) is an autosomal recessive metabolic genetic disorder characterized by a mutation in the gene for the hepatic enzyme phenylalanine hydroxylase (PAH), rendering it nonfunctional. This enzyme is necessary to metabolize phenylalanine to tyrosine. When PAH activity is reduced, phenylalanine accumulates and is converted into phenylpyruvate (also known as phenylketone), which is detected in the urine. Untreated children are normal at birth, but fail to attain early developmental milestones, develop microcephaly, and demonstrate progressive impairment of cerebral function. Hyperactivity, EEG abnormalities and seizures, and severe learning disabilities are major clinical problems later in life. A characteristic odor of skin, hair, sweat and urine (due to phenylacetate accumulation); and a tendency to hypopigmentation and eczema are also observed. All PKU patients must adhere to a special diet low in Phe. Accordingly, nutritive proteins comprising a low number or no Phe residues are desirable for PKU patients. Such proteins can be obtained by selecting nutritive proteins provided herein that have few or no Phe residues. Accordingly, in some embodiments the nutritive protein comprises a ratio of Phe residues to total amino acid residues equal to or lower than 5%, 4%, 3%, 2%, or 1%. In some embodiments the nutritive protein comprises 10 or fewer Phe residues, 9 or fewer Phe residues, 8 or fewer Phe residues, 7 or fewer Phe residues, 6 or fewer Phe residues, 5 or fewer Phe residues, 4 or fewer Phe residues, 3 or fewer Phe residues, 2 or fewer Phe residues, 1 Phe residue, or no Phe residues. In some embodiments, the nutritive protein comprises no Phe residues.

Arginine is a conditionally nonessential amino acid, meaning most of the time it can be manufactured by the human body, and does not need to be obtained directly through the diet. Individuals who have poor nutrition, the elderly, or people with certain physical conditions (e.g., sepsis) may not produce sufficient amounts of arginine and therefore need to increase their intake of foods containing arginine. Arginine is believed to have beneficial health properties, including reducing healing time of injuries (particularly bone), and decreasing blood pressure, particularly high blood pressure during high risk pregnancies (preeclampsia). In addition, studies have shown that dietary supplementation with L-arginine is beneficial for enhancing the reproductive performance of pigs with naturally occurring in-trauterine growth retardation, enhancing protein deposition and postnatal growth of milk-fed piglets, normalizing plasma glucose levels in streptozotocin-induced diabetic rats, reducing fat mass in obese Zucker diabetic fatty (ZDF) rats, and improving vascular function in diabetic rats. In order to combine these benefits with at least one utility of the nutritive proteins disclosed herein, in some embodiments of the nutritive proteins disclosed herein the nutritive protein comprises a ration of Arginine residues to total amino acid residues in the nutritive protein of equal to or greater than 3%, equal to or greater than 4%, equal to or greater than 5%, equal to or greater than 6%, equal to or greater than 7%, equal to or greater than 8%, equal to or greater than 9%, equal to or greater than 10%, equal to or greater than 11%, or equal to or greater than 12%.

Digestibility is a parameter relevant to the nutritive benefits and utility of nutritive proteins. Information relating to the relative completeness of digestion can serve as a predictor of peptide bioavailability (Daniel, H., 2003. Molecular and Integrative Physiology of Intestinal Peptide Transport. Annual Review of Physiology, Volume 66, pp. 361-384). In some embodiments nutritive proteins disclosed herein are screened to assess their digestibility. Digestibility of nutritive proteins can be assessed by any suitable method known in the art. In some embodiments digestibility is assessed by a physiologically relevant in vitro digestion reaction that includes one or both phases of protein digestion, simulated gastric digestion and simulated intestinal digestion (see, e.g., Moreno, et al., 2005. Stability of the major allergen Brazil nut 2S albumin (Ber e 1) to physiologically relevant in vitro gastrointestinal digestion. FEBS Journal, pp. 341-352; Martos, G., Contreras, P., Molina, E. & Lopez-Fandino, R., 2010. Egg White Ovalbumin Digestion Mimicking Physiological Conditions. Journal of Agricultural and food chemistry, pp. 5640-5648; Moreno, F. J., Mackie, A. R. & Clare Mills, E. N., 2005. Phospholipid interactions protect the milk allergen a-Lactalbumin from proteolysis during in vitro digestion. Journal of agricultural and food chemistry, pp. 9810-9816). Briefly, test proteins are sequentially exposed to a simulated gastric fluid (SGF) for 120 minutes (the length of time it takes 90% of a liquid meal to pass from the stomach to the small intestine; see Kong, F. & Singh, R. P., 2008. Disintegration of Solid Foods in Human Stomach. Journal of Food Science, pp. 67-80) and then transferred to a simulated duodenal fluid (SDF) to digest for an additional 120 minutes. Samples at different stages of the digestion (e.g., 2, 5, 15, 30, 60 and 120 min) are analyzed by electrophoresis (e.g., chip electrophoresis or SDS-PAGE) to monitor the size and amount of intact protein as well as any large digestion fragments (e.g., larger than 4 kDa). The disappearance of protein over time indicates the rate at which the protein is digested in the assay. By monitoring the amount of intact protein observed over time, the half-life ($\tau\frac{1}{2}$) of digestion is calculated for SGF and, if intact protein is detected after treatment with SGF, the $\tau\frac{1}{2}$ of digestion is calculated for SIF. This assay can be used to assess comparative digestibility (i.e., against a benchmark protein such as whey) or to assess absolute digestibility. In some embodiments the digestibility of the nutritive protein is higher (i.e., the SGF $\tau\frac{1}{2}$ and/or SIF $\tau\frac{1}{2}$ is shorter) than whey protein. In some embodiments the nutritive protein has a SGF $\tau\frac{1}{2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the nutritive protein has a SIF $\tau\frac{1}{2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the nutritive protein is not detectable in one or both of the SGF and SIF assays by 2 minutes, 5 minutes, 15 minutes, 30 minutes, 60 minutes, or 120 minutes. In some embodiments the nutritive protein is digested at a constant rate and/or at a controlled rate in one or both of SGF and SIF. In such embodiments the rate of digestion of the nutritive protein may not be optimized for the highest possible rate of digestion. In such embodiments the rate of absorption of the protein following ingestion by a mammal may be slower and the total time period over which absorption occurs following ingestion may be longer than for nutritive proteins of similar amino acid composition that are digested at a faster initial rate in one or both of SGF and SIF. In some embodiments the nutritive protein is completely or substantially completely digested in SGF. In some embodiments the nutritive protein is substantially not digested or not digested by SGF; in most such embodiments the protein is digested in SIF.

Assessing protein digestibility can also provide insight into a protein's potential allergenicity, as proteins or large fragments of proteins that are resistant to digestive proteases can have a higher risk of causing an allergenic reaction (Goodman, R. E. et al., 2008. Allergenicity assessment of genetically modified crops—what makes sense?Nature Biotechnology, pp. 73-81). To detect and identify peptides too small for chip electrophoresis analysis, liquid chromatography and mass spectrometry can be used. In SGF samples, peptides can be directly detected and identified by LC/MS. SIF protein digestions may require purification to remove bile acids before detection and identification by LC/MS.

In some embodiments digestibility of a nutritive protein is assessed by identification and quantification of digestive protease recognition sites in the protein amino acid sequence. In some embodiments the nutritive protein comprises at least one protease recognition site selected from a pepsin recognition site, a trypsin recognition site, and a chymotrypsin recognition site.

As used herein, a "pepsin recognition site" is any site in a polypeptide sequence that is experimentally shown to be cleaved by pepsin. In some embodiments it is a peptide bond after (i.e., downstream of) an amino acid residue selected from Phe, Trp, Tyr, Leu, Ala, Glu, and Gln, provided that the following residue is not an amino acid residue selected from Ala, Gly, and Val.

As used herein, a "trypsin recognition site" is any site in a polypeptide sequence that is experimentally shown to be cleaved by trypsin. In some embodiments it is a peptide bond after an amino acid residue selected from Lys or Arg, provided that the following residue is not a proline.

As used herein, a "chymotrypsin recognition site" is any site in a polypeptide sequence that is experimentally shown to be cleaved by chymotrypsin. In some embodiments it is a peptide bond after an amino acid residue selected from Phe, Trp, Tyr, and Leu. Disulfide bonded cysteine residues in a protein tend to reduce the rate of digestion of the protein compared to what it would be in the absence of the disulfide bond. For example, it has been shown that the rate of digestion of the protein b-lactoglobulin is increased when its disulfide bridges are cleaved (I. M. Reddy, N. K. D. Kella, and J. E. Kinsella. "Structural and Conformational Basis of the Resistance of B-Lactoglobulin to Peptic and Chymotryptic Digestion". J. Agric. Food Chem. 1988, 36, 737-741). Accordingly, digestibility of a nutritive protein with fewer disulfide bonds tends to be higher than for a comparable nutritive protein with a greater number of disulfide bonds. In some embodiments the nutritive proteins disclosed herein are screened to identify the number of cysteine residues present in each and in particular to allow selection of a nutritive protein comprising a relatively low number of cysteine residues. For example, naturally occurring nutritive proteins or fragments may be identified that comprise a no Cys residues or that comprise a relatively low number of Cys residues, such as 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments one or more Cys residues in a naturally occurring nutritive protein or fragment thereof is removed by deletion and/or by substitution with another amino acid. In some embodiments 1 Cys residue is deleted or replaced, 1 or more Cys residues are deleted or replaced, 2 or more Cys residues are deleted or replaced, 3 or more Cys residues are deleted or replaced, 4 or more Cys residues are deleted or replaced, 5 or more Cys residues are deleted or replaced, 6 or more Cys residues are deleted or replaced, 7 or more Cys residues are deleted or replaced, 8 or more Cys residues are deleted or replaced, 9 or more Cys residues are deleted or replaced, or 10 or more Cys residues are deleted or replaced. In some embodiments the nutritive protein of this disclosure comprises a ratio of Cys residues to total amino acid residues equal to or lower than 5%, 4%, 3%, 2%, or 1%. In some embodiments the nutritive protein comprises 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments, the nutritive protein comprises 1 or fewer Cys residues. In some embodiments, the nutritive protein comprises no Cys residues.

Alternatively or in addition, disulfide bonds that are or may be present in a nutritive protein may be removed. Disulfides can be removed using chemical methods by reducing the disulfide to two thiol groups with reducing agents such as beta-mercaptoethanol, dithiothreitol (DTT), or tris(2-carboxyethyl)phosphine (TCEP). The thiols can then be covalently modified or "capped" with reagents such as iodoacetamide, N-ethylmaleimide, or sodium sulfite (see, e.g., Crankshaw, M. W. and Grant, G. A. 2001. Modification of Cysteine. Current Protocols in Protein Science. 15.1.1-15.1.18).

Eukaryotic proteins are often glycosylated, and the carbohydrate chains that are attached to proteins serve various functions. N-linked and O-linked glycosylation are the two most common forms of glycosylation occurring in proteins. N-linked glycosylation is the attachment of a sugar molecule to a nitrogen atom in an amino acid residue in a protein. N-linked glycosylation occurs at Asparagine and Arginine residues. O-linked glycosylation is the attachment of a sugar molecule to an oxygen atom in an amino acid residue in a protein. O-linked glycosylation occurs at Threonine and Serine residues.

Glycosylated proteins are often more soluble than their un-glycosylated forms. In terms of protein drugs, proper glycosylation usually confers high activity, proper antigen binding, better stability in the blood, etc. However, glycosylation necessarily means that a protein "carries with it" sugar moieties. Such sugar moieties may reduce the usefulness of the nutritive proteins of this disclosure including recombinant nutritive proteins. For example, as demonstrated in the examples, a comparison of digestion of glycosylated and non-glycosylated forms of the same proteins shows that the non-glycosylated forms are digested more quickly than the glycosylated forms. For these reasons, in some embodiments the nutritive proteins according to the disclosure comprise low or no glycosylation. For example, in some embodiments the nutritive proteins comprise a ratio of non-glycosilated to total amino acid residues of at least 80%, at least 85%, at least 90%, at least 95%, at least 96%, at least 97%, at least 98%, or at least 99%. In some embodiments the nutritive proteins to not comprise any glycosylation.

In some embodiments, the nutritive protein according to the disclosure is de-glycosylated after it is produced or after it is isolated. Nutritive proteins of low or no glycosylation may be made by any method known in the art. For example, enzymatic and/or chemical methods may be used (Biochem. J. (2003) 376, p 339-350.). Enzymes are produced commercially at research scales for the removal of N-linked and O-linked oligosaccharides. Chemical methods include use of trifluoromethanesulfonic acid to selectively break N-linked and O-linked peptide-saccharide bonds. This method often results in a more complete deglycosylation than does the use of enzymatic methods.

In other embodiments, the nutritive protein according to the disclosure is produced with low or no glycosylation by a host organism. Most bacteria and other prokaryotes have very limited capabilities to glycosylate proteins, especially heterologous proteins. Accordingly, in some embodiments of this disclosure a nutritive protein is made recombinantly in a microorganism such that the level of glycosylation of the recombinant protein is low or no glycosylation. In some embodiments the level of glycosylation of the recombinant nutritive protein is lower than the level of glycosylation of the protein as it occurs in the organism from which it is derived.

In some embodiments a nutritive protein or polypeptide according to the disclosure comprises a ratio of amino acids selected from Asn, Arg, Ser, and Thr to total amino acids of 20% or less, 19% or less, 18% or less, 17% or less, 16% or less, 15% or less, 14% or less, 13% or less, 12% or less, 11% or less, 10% or less, 9% or less, 8% or less, 7% or less, 6% or less, 5% or less, 4% or less, 3% or less, 2% or less, 1% or less. In some embodiments, a nutritive protein or polypeptide according to the disclosure comprises no amino acids selected from Asn, Arg, Ser, and Thr. In some embodiments a nutritive protein or polypeptide according to the disclosure comprises fewer than 20, fewer than 19, fewer than 18, fewer than 17, fewer than 16, fewer than 15, fewer than 14, fewer than 13, fewer than 12, fewer than 11, fewer than 10, fewer than 9, fewer than 8, fewer than 7, fewer than 6, fewer than 5, fewer than 4, fewer than 3, fewer than 2, fewer than 1, or no amino acids selected from Asn, Arg, Ser, and Thr.

In some embodiments of the nutritive proteins disclosed herein the nutritive protein is soluble. Solubility can be measured by any method known in the art. In some embodiments solubility is examined by centrifuge concentration followed by protein concentration assays. Samples of nutritive proteins in 20 mM HEPES pH 7.5 are tested for protein concentration according to protocols using two methods, Coomassie Plus (Bradford) Protein Assay (Thermo Scientific) and Bicinchoninic Acid (BCA) Protein Assay (Sigma-Aldrich). Based on these measurements 10 mg of protein is added to an Amicon Ultra 3 kDa centrifugal filter (Millipore). Samples are concentrated by centrifugation at 10,000×g for 30 minutes. The final, now concentrated, samples are examined for precipitated protein and then tested for protein concentration as above using two methods, Bradford and BCA.

In some embodiments the nutritive proteins have a final solubility limit of at least 5 g/L, 10 g/L, 20 g/L, 30 g/L, 40 g/L, 50 g/L, or 100 g/L at physiological pH. In some embodiments the nutritive proteins are greater than 50%, greater than 60%, greater than 70%, greater than 80%, greater than 90%, greater than 95%, greater than 96%, greater than 97%, greater than 98%, greater than 99%, or greater than 99.5% soluble with no precipitated protein observed at a concentration of greater than 5 g/L, or 10 g/L, or 20 g/L, or 30 g/L, or 40 g/L, or 50 g/L, or 100 g/L at physiological pH. In some embodiments, the solubility of the nutritive protein is higher than those typically reported in studies examining the solubility limits of whey (12.5 g/L; Pelegrine et al., Lebensm.-Wiss. U.-Technol. 38 (2005) 77-80) and soy (10 g/L; Lee et al., JAOCS 80(1) (2003) 85-90).

As used herein, a "stable" protein is one that resists changes (e.g., unfolding, oxidation, aggregation, hydrolysis, etc.) that alter the biophysical (e.g., solubility), biological (e.g., digestibility), or compositional (e.g. proportion of Leucine amino acids) traits of the protein of interest.

Protein stability can be measured using various assays known in the art and nutritive proteins disclosed herein and having stability above a threshold can be selected. In some embodiments a protein is selected that displays thermal stability that is comparable to or better than that of whey protein. Thermal stability is a property that can help predict the shelf life of a nutritive protein. In some embodiments of the assay stability of nutritive protein samples is determined by monitoring aggregation formation using size exclusion chromatography (SEC) after exposure to extreme temperatures. Aqueous samples of the protein to be tested are placed in a heating block at 90° C. and samples are taken after 0, 1, 5, 10, 30 and 60 min for SEC analysis. Protein is detected by monitoring absorbance at 214 nm, and aggregates are characterized as peaks eluting faster than the protein of interest. No overall change in peak area indicates no precipitation of protein during the heat treatment. Whey protein has been shown to rapidly form 80% aggregates when exposed to 90° C. in such an assay.

In some embodiments the thermal stability of a nutritive protein is determined by heating a sample slowly from 25° C. to 95° C. in presence of a hydrophobic dye (e.g., ProteoStat® Thermal shift stability assay kit, Enzo Life Sciences) that binds to aggregated proteins that are formed as the protein denatures with increasing temperature (Niesen, F. H., Berglund, H. & Vadadi, M., 2007. The use of differential scanning fluorimetry to detect ligand interactions that promote protein stability. Nature Protocols, Volume 2, pp. 2212-2221). Upon binding, the dye's fluorescence increases significantly, which is recorded by an rtPCR instrument and represented as the protein's melting curve (Lavinder, J. J., Hari, S. B., Suillivan, B. J. & Magilery, T. J., 2009. High-Throughput Thermal Scanning: A General, Rapid Dye-Binding Thermal Shift Screen for Protein Engineering. Journal of the American Chemical Society, pp. 3794-3795). After the thermal shift is complete, samples are examined for insoluble precipitates and further analyzed by analytical size exclusion chromatography (SEC).

In some embodiments a nutritive protein of this disclosure shows resistance to aggregation, exhibiting, for example, less than 80% aggregation, 10% aggregation, or no detectable aggregation at elevated temperatures (e.g., 50° C., 60° C., 70° C., 80° C., 85° C., 90° C., or 95° C.).

One benefit of stable nutritive proteins as disclosed herein is that they may be able to be stored for an extended period of time before use, in some instances without the need for refrigeration or cooling. In some embodiments, nutritive proteins are processed into a dry form (e.g., by lyophilization). In some embodiments, nutritive proteins are stable upon lyophilization. In some embodiments, such lyophilized nutritive proteins maintain their stability upon reconstitution (e.g., liquid formulation).

For most embodiments it is preferred that the nutritive protein not exhibit inappropriately high allergenicity.

Accordingly, in some embodiments the potential allergenicity of the nutritive protein is assessed. This can be done by any suitable method known in the art. In some embodiments an allergenicity score is calculated. The allergenicity score is a primary sequence based metric based on WHO recommendations (http://www.fao.org/ag/agn/food/pdf/allergygm.pdf) for assessing how similar a protein is to any known allergen, the primary hypothesis being that high percent identity between a target and a known allergen is likely indicative of cross reactivity. For a given protein, the likelihood of eliciting an allergic response can be assessed via one or both of a complimentary pair of sequence homology based tests. The first test determines the protein's percent identity across the entire sequence via a global-global sequence alignment to a database of known allergens using the FASTA algorithm with the BLOSUM50 substitution matrix, a gap open penalty of 10, and a gap extension penalty of 2. It has been suggested that proteins with less than 50% global homology are unlikely to be allergenic (Goodman R. E. et al. Allergenicity assessment of genetically modified crops—what makes sense?Nat. Biotech. 26, 73-81 (2008); Aalberse R. C. Structural biology of allergens. J. Allergy Clin. Immunol. 106, 228-238 (2000)).

In some embodiments of a nutritive protein, the nutritive protein has less than 50% global homology to any known allergen in the database used for the analysis. In some embodiments a cutoff of less than 40% homology is used. In some embodiments a cutoff of less than 30% homology is used. In some embodiments a cutoff of less than 20% homology is used. In some embodiments a cutoff of less than 10% homology is used. In some embodiments a cutoff of from 40% to 50% is used. In some embodiments a cutoff of from 30% to 50% is used. In some embodiments a cutoff of from 20% to 50% is used. In some embodiments a cutoff of from 10% to 50% is used. In some embodiments a cutoff of from 5% to 50% is used. In some embodiments a cutoff of from 0% to 50% is used. In some embodiments a cutoff of greater than 50% global homology to any known allergen in the database used for the analysis is used. In some embodiments a cutoff of from 50% to 60% is used. In some embodiments a cutoff of from 50% to 70% is used. In some embodiments a cutoff of from 50% to 80% is used. In some embodiments a cutoff of from 50% to 90% is used. In some embodiments a cutoff of from 55% to 60% is used. In some embodiments a cutoff of from 65% to 70% is used. In some embodiments a cutoff of from 70% to 75% is used. In some embodiments a cutoff of from 75% to 80% is used.

The second test assesses the local allergenicity along the protein sequence by determining the local allergenicity of all possible contiguous 80 amino acid fragments via a global-local sequence alignment of each fragment to a database of known allergens using the FASTA algorithm with the BLOSUM50 substitution matrix, a gap open penalty of 10, and a gap extension penalty of 2. The highest percent identity of any 80 amino acid window with any allergen is taken as the final score for the protein of interest. The WHO guidelines suggest using a 35% identity cutoff with this fragment test. In some embodiments of a nutritive protein, all possible fragments of the nutritive protein have less than 35% local homology to any known allergen in the database used for the analysis using this test. In some embodiments a cutoff of less than 30% homology is used. In some embodiments a cutoff of from 30% to 35% homology is used. In some embodiments a cutoff of from 25% to 30% homology is used. In some embodiments a cutoff of from 20% to 25% homology is used. In some embodiments a cutoff of from 15% to 20% homology is used. In some embodiments a cutoff of from 10% to 15% homology is used. In some embodiments a cutoff of from 5% to 10% homology is used. In some embodiments a cutoff of from 0% to 5% homology is used. In some embodiments a cutoff of greater than 35% homology is used. In some embodiments a cutoff of from 35% to 40% homology is used. In some embodiments a cutoff of from 40% to 45% homology is used. In some embodiments a cutoff of from 45% to 50% homology is used. In some embodiments a cutoff of from 50% to 55% homology is used. In some embodiments a cutoff of from 55% to 60% homology is used. In some embodiments a cutoff of from 65% to 70% homology is used. In some embodiments a cutoff of from 70% to 75% homology is used. In some embodiments a cutoff of from 75% to 80% homology is used.

Skilled artisans are able to identify and use a suitable database of known allergens for this purpose. In some embodiments the database is custom made by selecting proteins from more than one database source. In some embodiments the custom database comprises pooled allergen lists collected by the Food Allergy Research and Resource Program (http://www.allergenonline.org/), UNIPROT annotations (http://www.uniprot.org/docs/allergen), and the Structural Database of Allergenic Proteins (SDAP, http://fermi.utmb.edu/SDAP/sdap_lnk.html). This database includes all currently recognized allergens by the International Union of Immunological Societies (IUIS, http://www.allergen.org/) as well as a large number of additional allergens not yet officially named. In some embodiments the database comprises a subset of known allergen proteins available in known databases; that is, the database is a custom selected subset of known allergen proteins. In some embodiments the database of known allergens comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known allergens comprises from 100 to 500 proteins, from 200 to 1,000 proteins, from 500 to 1,000 proteins, from 500 to 1,000 proteins, or from 1,000 to 2,000 proteins.

In some embodiments all (or a selected subset) of contiguous amino acid windows of different lengths (e.g., 70, 60, 50, 40, 30, 20, 10, 8 or 6 amino acid windows) of a nutritive protein are tested against the allergen database and peptide sequences that have 100% identity, 95% or higher identity, 90% or higher identity, 85% or higher identity, 80% or higher identity, 75% or higher identity, 70% or higher identity, 65% or higher identity, 60% or higher identity, 55% or higher identity, or 50% or higher identity matches are identified for further examination of potential allergenicity.

Another method of predicting the allergenicity of a protein is to assess the homology of the protein to a protein of human origin. The human immune system is exposed to a multitude of possible allergenic proteins on a regular basis and has the intrinsic ability to differentiate between the host body's proteins and exogenous proteins. The exact nature of this ability is not always clear, and there are many diseases that arise as a result of the failure of the body to differentiate self from non-self (e.g. arthritis). Nonetheless, the fundamental hypothesis is that proteins that share a degree of sequence homology to human proteins are less likely to elicit an immune response. In particular, it has been shown that for some protein families with known allergenic members (tropomyosins, parvalbumins, caseins), those proteins that bear more sequence homology to their human counterparts relative to known allergenic proteins, are not thought to be allergenic (Jenkins J. A. et al. Evolutionary distance from human homologs reflects allergenicity of animcal food proteins. J. Allergy Clin Immunol. 120 (2007): 1399-1405). For a given protein, a human homology score is measured by determining the maximum percent identity of the protein to a database of human proteins (e.g., the UNIPROT database) from a global-local alignment using the FASTA algorithm with the BLOSUM50 substitution matrix, a gap open penalty of 10, and a gap extension penalty of 2. According to Jenkins et al. (Jenkins J. A. et al. Evolutionary distance from human homologs reflects allergenicity of animal food proteins. J. Allergy Clin Immunol. 120 (2007): 1399-1405) proteins with a sequence identity to a human protein above about 62% are less likely to be allergenic. Skilled artisans are able to identify and use a suitable database of known human proteins for this purpose, for example, by searching the UNIPROT database (http://www.uniprot.org). In some embodiments the database is custom made by selecting proteins from more than one database source. Of course the database may but need not be comprehensive. In some embodiments the database comprises a subset of human proteins; that is, the database is a custom selected subset of human proteins. In some embodiments the database of human proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins. In some embodiments the database comprises at least 90%, at least 95%, or at least 99% of all known human proteins.

In some embodiments of a nutritive protein, the nutritive protein is at least 20% homologous to a human protein. In some embodiments a cutoff of at least 30% homology is used. In some embodiments a cutoff of at least 40% homology is used. In some embodiments a cutoff of at least 50% homology is used. In some embodiments a cutoff of at least 60% homology is used. In some embodiments a cutoff of at least 70% homology is used. In some embodiments a cutoff of at least 80% homology is used. In some embodiments a cutoff of at least 62% homology is used. In some embodiments a cutoff of from at least 20% homology to at least 30% homology is used. In some embodiments a cutoff of from at least 30% homology to at least 40% homology is used. In some embodiments a cutoff of from at least 50% homology to at least 60% homology is used. In some embodiments a cutoff of from at least 60% homology to at least 70% homology is used. In some embodiments a cutoff of from at least 70% homology to at least 80% homology is used.

For most embodiments it is preferred that the nutritive protein not exhibit inappropriately high toxicity. Accordingly, in some embodiments the potential toxicity of the nutritive protein is assessed. This can be done by any suitable method known in the art. In some embodiments a toxicity score is calculated by determining the protein's percent identity to databases of known toxic proteins (e.g., toxic proteins identified from the UNIPROT database). A global-global alignment of the protein of interest against the database of known toxins is performed using the FASTA algorithm with the BLOSUM50 substitution matrix, a gap open penalty of 10, and a gap extension penalty of 2. In some embodiments of a nutritive protein, the nutritive protein is less than 35% homologous to a known toxin. In some embodiments a cutoff of less than 35% homology is used. In some embodiments a cutoff of from 30% to 35% homology is used. In some embodiments a cutoff of from 25% to 35% homology is used. In some embodiments a cutoff of from 20% to 35% homology is used. In some embodiments a cutoff of from 15% to 35% homology is used. In some embodiments a cutoff of from 10% to 35% homology is used. In some embodiments a cutoff of from 5% to 35% homology is used. In some embodiments a cutoff of from 0% to 35% homology is used. In some embodiments a cutoff of greater than 35% homology is used. In some embodiments a cutoff of from 35% to 40% homology is used. In some embodiments a cutoff of from 35% to 45% homology is used. In some embodiments a cutoff of from 35% to 50% homology is used. In some embodiments a cutoff of from 35% to 55% homology is used. In some embodiments a cutoff of from 35% to 60% homology is used. In some embodiments a cutoff of from 35% to 70% homology is used. In some embodiments a cutoff of from 35% to 75% homology is used. In some embodiments a cutoff of from 35% to 80% homology is used. Skilled artisans are able to identify and use a suitable database of known toxins for this purpose, for example, by searching the UNIPROT database (http://www.uniprot.org). In some embodiments the database is custom made by selecting proteins identified as toxins from more than one database source. In some embodiments the database comprises a subset of known toxic proteins; that is, the database is a custom selected subset of known toxic proteins. In some embodiments the database of toxic proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins.

For some embodiments it is preferred that the nutritive protein not exhibit anti-nutritional activity ("anti-nutricity"), i.e., proteins that have the potential to prevent the absorption of nutrients from food. Examples of anti-nutritive factors include protease inhibitors, which inhibit the actions of trypsin, pepsin and other proteases in the gut, preventing the digestion and subsequent absorption of protein. Accordingly, in some embodiments the potential anti-nutricity of the nutritive protein is assessed. This can be done by any suitable method known in the art. In some embodiments an anti-nutricity score is calculated by determining the protein's percent identity to databases of known protease inhibitors (e.g., protease inhibitors identified from the UNIPROT database). A global-global alignment of the protein of interest against the database of known protease inhibitors is performed using the FASTA algorithm with the BLOSUM50 substitution matrix, a gap open penalty of 10, and a gap extension penalty of 2, to identify whether the nutritive protein is homologous to a known anti-nutritive protein. In some embodiments of a nutritive protein, the nutritive protein has less than 35% global homology to any known anti-nutritive protein (e.g., any known protease inhibitor) in the database used for the analysis. In some embodiments a cutoff of less than 35% identify is used. In some embodiments a cutoff of from 30% to 35% is used. In some embodiments a cutoff of from 25% to 35% is used. In some embodiments a cutoff of from 20% to 35% is used. In some embodiments a cutoff of from 15% to 35% is used. In some embodiments a cutoff of from 10% to 35% is used. In some embodiments a cutoff of from 5% to 35% is used. In some embodiments a cutoff of from 0% to 35% is used. In some embodiments a cutoff of greater than 35% identify is used. In some embodiments a cutoff of from 35% to 40% is used. In some embodiments a cutoff of from 35% to 45% is used. In some embodiments a cutoff of from 35% to 50% is used. In some embodiments a cutoff of from 35% to 55% is used. In some embodiments a cutoff of from 35% to 60% is used. In some embodiments a cutoff of from 35% to 70% is used. In some embodiments a cutoff of from 35% to 75% is used. In some embodiments a cutoff of from 35% to 80% is used. Skilled artisans are able to identify and use a suitable database of known protease inhibitors for this purpose, for example, by searching the UNIPROT database (http://www.uniprot.org). In some embodiments the database is custom made by selecting proteins identified protease-inhibitors as from more than one database source. In some embodiments the database comprises a subset of known protease inhibitors available in databases; that is, the database is a custom selected subset of known protease inhibitor proteins. In some embodiments the database of known protease inhibitor proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known protease inhibitor proteins comprises from 100 to 500 proteins, from 200 to 1,000 proteins, from 500 to 1,000 proteins, from 500 to 1,000 proteins, or from 1,000 to 2,000 proteins, or from 2,000 to 3,000 proteins.

In other embodiments a nutritive protein that does exhibit some degree of protease inhibitor activity is used. For example, in some embodiments such a protein may be useful because it delays protease digestion when the nutritive protein is consumed such that the nutritive protein traverse a greater distance within the GI tract before it is digested, thus delaying absorption. For example, in some embodiments the nutritive protein inhibits gastric digestion but not intestinal digestion.

Delaney B. et al. (Evaluation of protein safety in the context of agricultural biotechnology. Food. Chem. Toxicol. 46 (2008: S71-S97)) suggests that one should avoid both known toxic and anti-nutritive proteins when assessing the safety of a possible food protein. In some embodiments of a nutritive protein, the nutritive protein has a favorably low level of global homology to a database of known toxic proteins and/or a favorably low level of global homology to a database of known anti-nutricity proteins (e.g., protease inhibitors), as defined herein.

One feature that can enhance the utility of a nutritive protein is its charge (or per amino acid charge). Nutritive proteins with higher charge can in some embodiments exhibit desirable characteristics such as increased solubility, increased stability, resistance to aggregation, and desirable taste profiles. For example, a charged nutritive protein that exhibits enhanced solubility can be formulated into a beverage or liquid formulation that includes a high concentration of nutritive protein in a relatively low volume of solution, thus delivering a large dose of protein nutrition per unit volume. A charged nutritive protein that exhibits enhanced solubility can be useful, for example, in sports drinks or recovery drinks wherein a user (e.g., an athlete) wants to ingest nutritive protein before, during or after physical activity. A charged nutritive protein that exhibits enhanced solubility can also be particularly useful in a clinical setting wherein a subject (e.g., a patient or an elderly person) is in need of protein nutrition but is unable to ingest solid foods or large volumes of liquids.

For example, the net charge (ChargeP) of a polypeptide at pH 7 can be calculated using the following formula:

$$\text{Charge}P = -0.002 - (C)0.045 - (D)0.999 - (E)(0.998) + (H)0.091 + (K)(1.0) + (R)(1.0) - (Y)(-0.001)$$

where C is the number of cysteine residues, D is the number of aspartic acid residues, E is the number of glutamic acid residues, H is the number of histidine residues, K is the number of lysine residues, R is the number of arginine residues and Y is the number of tyrosine residues in the polypeptide. The per amino acid charge (ChargeA) of the polypeptide can be calculated by dividing the net charge (ChargeP) by the number of amino acid residues (N), i.e., ChargeA=ChargeP/N. (See Bassi S (2007), "A Primer on Python for Life Science Researchers." PLoS Comput Biol 3(11): e199. doi: 10.1371/journal.pcbi.0030199).

One metric for assessing the hydrophilicity and potential solubility of a given protein is the solvation score. Solvation score is defined as the total free energy of solvation (i.e. the free energy change associated with transfer from gas phase to a dilute solution) for all amino acid side chains if each residue were solvated independently, normalized by the total number of residues in the sequence. The side chain solvation free energies are found computationally by calculating the electrostatic energy difference between a vacuum dielectric of 1 and a water dielectric of 80 (by solving the Poisson-Boltzmann equation) as well as the non-polar, Van der Waals energy using a linear solvent accessible surface area model (D. Sitkoff, K. A. Sharp, B. Honig. "Accurate Calculation of Hydration Free Energies Using Macroscopic Solvent Models". J. Phys. Chem. 98, 1994). For amino acids with ionizable sidechains (Arg, Asp, Cys, Glu, His, Lys and Tyr), an average solvation free energy is used based on the relative probabilities for each ionization state at the specified pH. Solvation scores start at 0 and continue into negative values, and the more negative the solvation score, the more hydrophilic and potentially soluble the protein is predicted to be. In some embodiments of a nutritive protein, the nutritive protein has a solvation score of −10 or less at pH 7. In some embodiments of a nutritive protein, the nutritive protein has a solvation score of −15 or less at pH 7. In some embodiments of a nutritive protein, the nutritive protein has a solvation score of −20 or less at pH 7. In some embodiments of a nutritive protein, the nutritive protein has a solvation score of −25 or less at pH 7. In some embodiments of a nutritive protein, the nutritive protein has a solvation score of −30 or less at pH 7. In some embodiments of a nutritive protein, the nutritive protein has a solvation score of −35 or less at pH 7. In some embodiments of a nutritive protein, the nutritive protein has a solvation score of −40 or less at pH 7.

The solvation score is a function of pH by virtue of the pH dependence of the molar ratio of undissociated weak acid ([HA]) to conjugate base ([A−]) as defined by the Henderson-Hasselbalch equation:

$$pH = pKa + \log\left(\frac{[A^-]}{[HA]}\right)$$

All weak acids have different solvation free energies compared to their conjugate bases, and the solvation free energy used for a given residue when calculating the solvation score at a given pH is the weighted average of those two values.

Accordingly, in some embodiments of a nutritive protein, the nutritive protein has a solvation score of −10 or less at an acidic pH. In some embodiments of a nutritive protein, the nutritive protein has a solvation score of −15 or less at at an acidic pH. In some embodiments of a nutritive protein, the nutritive protein has a solvation score of −20 or less at an acidic pH. In some embodiments of a nutritive protein, the nutritive protein has a solvation score of −25 or less at an acidic pH. In some embodiments of a nutritive protein, the nutritive protein has a solvation score of −30 or less at an acidic pH. In some embodiments of a nutritive protein, the nutritive protein has a solvation score of −35 or less at an acidic pH. In some embodiments of a nutritive protein, the nutritive protein has a solvation score of −40 or less at acidic pH.

Accordingly, in some embodiments of a nutritive protein, the nutritive protein has a solvation score of −10 or less at a basic pH. In some embodiments of a nutritive protein, the nutritive protein has a solvation score of −15 or less at at a basic pH. In some embodiments of a nutritive protein, the nutritive protein has a solvation score of −20 or less at a basic pH. In some embodiments of a nutritive protein, the nutritive protein has a solvation score of −25 or less at a basic pH. In some embodiments of a nutritive protein, the nutritive protein has a solvation score of −30 or less at a basic pH. In some embodiments of a nutritive protein, the nutritive protein has a solvation score of −35 or less at a basic pH. In some embodiments of a nutritive protein, the nutritive protein has a solvation score of −40 or less at basic pH.

Accordingly, in some embodiments of a nutritive protein, the nutritive protein has a solvation score of −10 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −15 or less at at a pH range selected from 2-3, 3-4, 4-5, 5-6, 6-7, 7-8, 8-9, 9-10, 10-11, and 11-12. In some embodiments of a nutritive protein, the nutritive protein has a solvation score of −20 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −25 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −30 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −35 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −40 or less at a pH range selected from 2-3, 3-4, 4-5, 5-6, 6-7, 7-8, 8-9, 9-10, 10-11, and 11-12.

The aggregation score is a primary sequence based metric for assessing the hydrophobicity and likelihood of aggregation of a given protein. Using the Kyte and Doolittle hydrophobity scale (Kyte J, Doolittle R F (May 1982) "A simple method for displaying the hydropathic character of a protein". J. Mol. Biol. 157 (1): 105-32), which gives hydrophobic residues positive values and hydrophilic residues negative values, the average hydrophobicity of a protein sequence is calculated using a moving average of five residues. The aggregation score is drawn from the resulting plot by determining the area under the curve for values greater than zero and normalizing by the total length of the protein. The underlying hypothesis is that aggregation is the result of two or more hydrophobic patches coming together to exclude water and reduce surface exposure, and the likelihood that a protein will aggregate is a function of how densely packed its hydrophobic (i.e., aggregation prone) residues are. Aggregation scores start at 0 and continue into positive values, and the smaller the aggregation score, the less hydrophobic and potentially less prone to aggregation the protein is predicted to be. In some embodiments of a nutritive protein, the nutritive protein has an aggregation score of 2 or less. In some embodiments of a nutritive protein, the nutritive protein has an aggregation score of 1.5 or less. In some embodiments of a nutritive protein, the nutritive protein has an aggregation score of 1 or less. In some embodiments of a nutritive protein, the nutritive protein has an aggregation score of 0.9 or less. In some embodiments of a nutritive protein, the nutritive protein has an aggregation score of 0.8 or less. In some embodiments of a nutritive protein, the nutritive protein has an aggregation score of 0.7 or less. In some embodiments of a nutritive protein, the nutritive protein has an aggregation score of 0.6 or less. In some embodiments of a nutritive protein, the nutritive protein has an aggregation score of 0.5 or less. In some embodiments of a nutritive protein, the nutritive protein has an aggregation score of 0.4 or less. In some embodiments of a nutritive protein, the nutritive protein has an aggregation score of 0.3 or less. In some embodiments of a nutritive protein, the nutritive protein has an aggregation score of 0.2 or less. In some embodiments of a nutritive protein, the nutritive protein has an aggregation score of 0.1 or less.

In some cases, soluble expression is desirable because it can increase the amount and/or yield of the nutritive protein and facilitate one or more of the isolation and purification of the nutritive protein. In some embodiments, the nutritive proteins of this disclosure are solubly expressed in the host organism. Solvation score and aggregation score can be used to predict soluble expression of recombinant nutritive proteins in a host organism. As shown in Example 8, this disclosure provides evidence suggesting that nutritive proteins with solvation scores of ≤−20 and aggregation scores of ≤0.75 are more likely to be recombinantly expressed in a particular *E. coli* expression system. Moreover, the data also suggests that nutritive proteins with solvation scores of ≤−20 and aggregation scores of ≤0.5 are more likely to be solubly expressed in this system. Therefore, in some embodiments the nutritive protein of this disclosure has a solvation score of −20 or less. In some embodiments the nutritive protein has an aggregation score of 0.75 or less. In some embodiments the nutritive protein has an aggregation score of 0.5 or less. In some embodiments the nutritive protein has a solvation score of −20 or less and an aggregation score of 0.75 or less. In some embodiments the nutritive protein has a solvation score of −20 or less and an aggregation score of 0.5 or less.

Certain free amino acids and mixtures of free amino acids are known to have a bitter or otherwise unpleasant taste. In addition, hydrolysates of common proteins (e.g., whey and soy) often have a bitter or unpleasant taste. In some embodiments, nutritive proteins disclosed and described herein do not have a bitter or otherwise unpleasant taste. In some embodiments, nutritive proteins disclosed and described herein have a more acceptable taste as compared to at least one of free amino acids, mixtures of free amino acids, and/or protein hydrolysates. In some embodiments, nutritive proteins disclosed and described herein have a taste that is equal to or exceeds at least one of whey protein.

Proteins are known to have tastes covering the five established taste modalities: sweet, sour, bitter, salty and umami. The taste of a particular protein (or its lack thereof) can be attributed to several factors, including the primary structure, the presence of charged side chains, and the electronic and conformational features of the protein. In some embodiments, nutritive proteins disclosed and described herein are designed to have a desired taste (e.g., sweet, salty, umami) and/or not to have an undesired taste (e.g., bitter, sour). In this context "design" includes, for example, selecting naturally occurring proteins embodying features that achieve the desired taste property, as well as creating muteins of naturally-occurring proteins that have desired taste properties. For example, nutritive proteins can be designed to interact with specific taste receptors, such as sweet receptors (T1R2-T1R3 heterodimer) or umami receptors (T1R1-T1R3 heterodimer, mGluR4, and/or mGluR1). Further, nutritive proteins may be designed not to interact, or to have diminished interaction, with other taste receptors, such as bitter receptors (T2R receptors).

Nutritive proteins disclosed and described herein can also elicit different physical sensations in the mouth when ingested, sometimes referred to as "mouth feel". The mouth feel of the nutritive proteins may be due to one or more factors including primary structure, the presence of charged side chains, and the electronic and conformational features of the protein. In some embodiments, nutritive proteins elicit a buttery or fat-like mouth feel when ingested.

In some embodiments the nutritive protein comprises from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 45 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids. In some embodiments the nutritive protein consists of from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 2455 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids.

B. Nucleic Acids

Also provided herein are nucleic acids encoding nutritive polypeptides or proteins. In some embodiments the nucleic acid is isolated. In some embodiments the nucleic acid is purified.

In some embodiments of the nucleic acid, the nucleic acid comprises a nucleic acid sequence that encodes a first polypeptide sequence disclosed in Section A above. In some embodiments of the nucleic acid, the nucleic acid consists of a nucleic acid sequence that encodes a first polypeptide sequence disclosed in Section A above. In some embodiments of the nucleic acid, the nucleic acid comprises a nucleic acid sequence that encodes a nutritive protein disclosed in Section A above. In some embodiments of the nucleic acid, the nucleic acid consists of a nucleic acid sequence that encodes a nutritive protein disclosed in Section A above. In some embodiments of the nucleic acid the nucleic acid sequence that encodes the first polypeptide sequence is operatively linked to at least one expression control sequence. For example, in some embodiments of the nucleic acid the nucleic acid sequence that encodes the first polypeptide sequence is operatively linked to a promoter such as a promoter described in Section D below.

Accordingly, in some embodiments the nucleic acid molecule of this disclosure encodes a polypeptide or protein that itself is a nutritive polypeptide or protein. Such a nucleic acid molecule may be referred to as a "nutrive nucleic acid". In some embodiments the nutritive nucleic acid encodes a polypeptide or protein that itself comprises at least one of: a) a ratio of branch chain amino acid residues to total amino acid residues of at least 24%; b) a ratio of Leu residues to total amino acid residues of at least 11%; and c) a ratio of essential amino acid residues to total amino acid residues of at least 49%. In some embodiments the nutritive nucleic acid comprises at least 10 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, at least 500 nucleotides, at least 600 nucleotides, at least 700 nucleotides, at least 800 nucleotides, at least 900 nucleotides, at least 1,000 nucleotides. In some embodiments the nutritive nucleic acid comprises from 10 to 100 nucleotides, from 20 to 100 nucleotides, from 10 to 50 nucleotides, or from 20 to 40 nucleotides In some embodiments the nutritive nucleic acid comprises all or part of an open reading frame that encodes a naturally occurring nutritive polypeptide or protein. In some embodiments the nutritive nucleic acid consists of an open reading frame that encodes a fragment of a naturally occurring nutritive protein, wherein the open reading frame does not encode the complete naturally occurring nutritive protein.

In some embodiments the nutritive nucleic acid is a cDNA.

In some embodiments nucleic acid molecules are provided that comprise a sequence that is at least 50%, 60%, 70%, 80%, 85%, 90%, 95%, 96%, 97%, 98%, 99%, or 99.9% identical to a naturally occurring nutritive nucleic acid. In some embodiments nucleic acids are provided that hybridize under stringent hybridization conditions with at least one reference nutritive nucleic acid.

The nutritive nucleic acids and fragments thereof provided in this disclosure display utility in a variety of systems and methods. For example, the fragments may be used as probes in various hybridization techniques. Depending on the method, the target nucleic acid sequences may be either DNA or RNA. The target nucleic acid sequences may be fractionated (e.g., by gel electrophoresis) prior to the hybridization, or the hybridization may be performed on samples in situ. One of skill in the art will appreciate that nucleic acid probes of known sequence find utility in determining chromosomal structure (e.g., by Southern blotting) and in measuring gene expression (e.g., by Northern blotting). In such experiments, the sequence fragments are preferably detectably labeled, so that their specific hybridization to target sequences can be detected and optionally quantified. One of skill in the art will appreciate that the nucleic acid fragments of this disclosure may be used in a wide variety of blotting techniques not specifically described herein.

It should also be appreciated that the nucleic acid sequence fragments disclosed herein also find utility as probes when immobilized on microarrays. Methods for creating microarrays by deposition and fixation of nucleic acids onto support substrates are well known in the art. Reviewed in DNA Microarrays: A Practical Approach (Practical Approach Series), Schena (ed.), Oxford University Press (1999) (ISBN: 0199637768); Nature Genet. 21(1) (suppl): 1-60 (1999); Microarray Biochip: Tools and Technology, Schena (ed.), Eaton Publishing Company/BioTechniques Books Division (2000) (ISBN: 1881299376), the disclosures of which are incorporated herein by reference in their entireties. Analysis of, for example, gene expression using microarrays comprising nucleic acid sequence fragments, such as the nucleic acid sequence fragments disclosed herein, is a well-established utility for sequence fragments in the field of cell and molecular biology. Other uses for sequence fragments immobilized on microarrays are described in Gerhold et al., Trends Biochem. Sci. 24:168-173 (1999) and Zweiger, Trends Biotechnol. 17:429-436 (1999); DNA Microarrays: A Practical Approach (Practical Approach Series), Schena (ed.), Oxford University Press (1999) (ISBN: 0199637768); Nature Genet. 21(1)(suppl): 1-60 (1999); Microarray Biochip: Tools and Technology, Schena (ed.), Eaton Publishing Company/BioTechniques Books Division (2000) (ISBN: 1881299376).

C. Vectors

Also provided are vectors, including expression vectors, which comprise at least one of the nucleic acid molecules disclosed herein, as described further herein. In some embodiments, the vectors comprise at least one isolated nucleic acid molecule encoding a nutritive protein as disclosed herein. In alternative embodiments, the vectors comprise such a nucleic acid molecule operably linked to one or more expression control sequence. The vectors can thus be used to express at least one recombinant protein in a recombinant microbial host cell.

Suitable vectors for expression of nucleic acids in microorganisms are well known to those of skill in the art. Suitable vectors for use in cyanobacteria are described, for example, in Heidorn et al., "Synthetic Biology in Cyanobacteria: Engineering and Analyzing Novel Functions," Methods in Enzymology, Vol. 497, Ch. 24 (2011). Exemplary replicative vectors that can be used for engineering cyanobacteria as disclosed herein include pPMQAK1, pSL1211, pFC1, pSB2A, pSCR119/202, pSUN119/202, pRL2697, pRL25C, pRL1050, pSG111M, and pPBH201.

Other vectors such as pJB161 which are capable of receiving nucleic acid sequences disclosed herein may also be used. Vectors such as pJB161 comprise sequences which are homologous with sequences present in plasmids endogenous to certain photosynthetic microorganisms (e.g., plasmids pAQ1, pAQ3, and pAQ4 of certain *Synechococcus* species). Examples of such vectors and how to use them is known in the art and provided, for example, in Xu et al., "Expression of Genes in Cyanobacteria: Adaptation of Endogenous Plasmids as Platforms for High-Level Gene Expression in *Synechococcus* sp. PCC 7002," Chapter 21 in Robert Carpentier (ed.), "Photosynthesis Research Protocols," Methods in Molecular Biology, Vol. 684, 2011, which is hereby incorporated herein by reference. Recombination between pJB161 and the endogenous plasmids in vivo yield engineered microbes expressing the genes of interest from their endogenous plasmids. Alternatively, vectors can be engineered to recombine with the host cell chromosome, or the vector can be engineered to replicate and express genes of interest independent of the host cell chromosome or any of the host cell's endogenous plasmids.

A further example of a vector suitable for recombinant protein production is the pET system (Novagen®). This system has been extensively characterized for use in *E. coli* and other microorganisms. In this system, target genes are cloned in pET plasmids under control of strong bacteriophage T7 transcription and (optionally) translation signals; expression is induced by providing a source of T7 RNA polymerase in the host cell. T7 RNA polymerase is so selective and active that, when fully induced, almost all of the microorganism's resources are converted to target gene expression; the desired product can comprise more than 50% of the total cell protein a few hours after induction. It is also possible to attenuate the expression level simply by lowering the concentration of inducer. Decreasing the expression level may enhance the soluble yield of some target proteins. In some embodiments this system also allows for maintenance of target genes in a transcriptionally silent un-induced state.

In some embodiments of using this system, target genes are cloned using hosts that do not contain the T7 RNA polymerase gene, thus alleviating potential problems related to plasmid instability due to the production of proteins potentially toxic to the host cell. Once established in a non-expression host, target protein expression may be initiated either by infecting the host with λCE6, a phage that carries the T7 RNA polymerase gene under the control of the λpL and pI promoters, or by transferring the plasmid into an expression host containing a chromosomal copy of the T7 RNA polymerase gene under lacUV5 control. In the second case, expression is induced by the addition of IPTG or lactose to the bacterial culture or using an autoinduction medium. Other plasmids systems that are controlled by the lac operator, but do not require the T7 RNA polymerase gene and rely upon E. coli's native RNA polymerase include the pTrc plasmid suite (Invitrogen) or pQE plasmid suite (QIAGEN).

In other embodiments it is possible to clone directly into expression hosts. Two types of T7 promoters and several hosts that differ in their stringency of suppressing basal expression levels are available, providing great flexibility and the ability to optimize the expression of a wide variety of target genes.

Suitable vectors for expression of nucleic acids in mammalian cells typically comprise control functions provided by viral regulatory elements. For example, commonly used promoters are derived from polyoma virus, Adenovirus 2, cytomegalovirus, or Simian Virus 40.

D. Promoters

Promoters useful for expressing the recombinant genes described herein include both constitutive and inducible/repressible promoters. Examples of inducible/repressible promoters include nickel-inducible promoters (e.g., PnrsA, PnrsB; see, e.g., Lopez-Mauy et al., Cell (2002) v. 43: 247-256) and urea repressible promoters such as PnirA (described in, e.g., Qi et al., Applied and Environmental Microbiology (2005) v. 71: 5678-5684). Additional examples of inducible/repressible promoters include PnirA (promoter that drives expression of the nirA gene, induced by nitrate and repressed by urea) and Psuf (promoter that drives expression of the sufB gene, induced by iron stress). Examples of constitutive promoters include Pcpc (promoter that drives expression of the cpc operon), Prbc (promoter that drives expression of rubisco), PpsbAII (promoter that drives expression of PpsbAII), Pcro (lambda phage promoter that drives expression of cro). In other embodiments, a PaphII and/or a lacIq-Ptrc promoter can used to control expression. Where multiple recombinant genes are expressed in an engineered microorganism, the different genes can be controlled by different promoters or by identical promoters in separate operons, or the expression of two or more genes may be controlled by a single promoter as part of an operon.

Further non-limiting examples of inducible promoters may include, but are not limited to, those induced by expression of an exogenous protein (e.g., T7 RNA polymerase, SP6 RNA polymerase), by the presence of a small molecule (e.g., IPTG, galactose, tetracycline, steroid hormone, abscisic acid), by absence of small molecules (e.g., $CO_2$, iron, nitrogen), by metals or metal ions (e.g., copper, zinc, cadmium, nickel), and by environmental factors (e.g., heat, cold, stress, light, darkness), and by growth phase. In some embodiments, the inducible promoter is tightly regulated such that in the absence of induction, substantially no transcription is initiated through the promoter. In some embodiments, induction of the promoter does not substantially alter transcription through other promoters. Also, generally speaking, the compound or condition that induces an inducible promoter is not be naturally present in the organism or environment where expression is sought.

In some embodiments, the inducible promoter is induced by limitation of $CO_2$ supply to a cyanobacteria culture. By way of non-limiting example, the inducible promoter may be the promoter sequence of Synechocystis PCC 6803 that are up-regulated under the $CO_2$-limitation conditions, such as the cmp genes, ntp genes, ndh genes, sbt genes, chp genes, and rbc genes, or a variant or fragment thereof.

In some embodiments, the inducible promoter is induced by iron starvation or by entering the stationary growth phase. In some embodiments, the inducible promoter may be variant sequences of the promoter sequence of cyanobacterial genes that are up-regulated under Fe-starvation conditions such as isiA, or when the culture enters the stationary growth phase, such as isiA, phrA, sigC, sigB, and sigH genes, or a variant or fragment thereof.

In some embodiments, the inducible promoter is induced by a metal or metal ion. By way of non-limiting example, the inducible promoter may be induced by copper, zinc, cadmium, mercury, nickel, gold, silver, cobalt, and bismuth or ions thereof. In some embodiments, the inducible promoter is induced by nickel or a nickel ion. In some embodiments, the inducible promoter is induced by a nickel ion, such as $Ni^{2+}$. In another exemplary embodiment, the inducible promoter is the nickel inducible promoter from Synechocystis PCC 6803. In another embodiment, the inducible promoter may be induced by copper or a copper ion. In yet another embodiment, the inducible promoter may be induced by zinc or a zinc ion. In still another embodiment, the inducible promoter may be induced by cadmium or a cadmium ion. In yet still another embodiment, the inducible promoter may be induced by mercury or a mercury ion. In an alternative embodiment, the inducible promoter may be induced by gold or a gold ion. In another alternative embodiment, the inducible promoter may be induced by silver or a silver ion. In yet another alternative embodiment, the inducible promoter may be induced by cobalt or a cobalt ion. In still another alternative embodiment, the inducible promoter may be induced by bismuth or a bismuth ion.

In some embodiments, the promoter is induced by exposing a cell comprising the inducible promoter to a metal or metal ion. The cell may be exposed to the metal or metal ion by adding the metal to the microbial growth media. In certain embodiments, the metal or metal ion added to the microbial growth media may be efficiently recovered from the media. In other embodiments, the metal or metal ion remaining in the media after recovery does not substantially impede downstream processing of the media or of the bacterial gene products.

Further non-limiting examples of constitutive promoters include constitutive promoters from Gram-negative bacteria or a bacteriophage propagating in a Gram-negative bacterium. For instance, promoters for genes encoding highly expressed Gram-negative gene products may be used, such as the promoter for Lpp, OmpA, rRNA, and ribosomal proteins. Alternatively, regulatable promoters may be used in a strain that lacks the regulatory protein for that promoter. For instance $P_{lac}$, $P_{tac}$, and $P_{trc}$ may be used as constitutive promoters in strains that lack LacI. Similarly, P22 $P_R$ and $P_L$ may be used in strains that lack the lambda C2 repressor protein, and lambda $P_R$ and $P_L$ may be used in strains that lack the lambda C1 repressor protein. In one embodiment, the constitutive promoter is from a bacteriophage. In another embodiment, the constitutive promoter is from a Salmonella bacteriophage. In yet another embodiment, the constitutive promoter is from a cyanophage. In some embodiments, the constitutive promoter is a *Synechocystis* promoter. For instance, the constitutive promoter may be the PpsbAll promoter or its variant sequences, the Prbc promoter or its variant sequences, the P, promoter or its variant sequences, and the PrnpB promoter or its variant sequences.

E. Host Cells

Also provided are host cells transformed with the nucleic acid molecules or vectors disclosed herein, and descendants thereof. In some embodiments the host cells are microbial cells. In some embodiments, the host cells carry the nucleic acid sequences on vectors, which may but need not be freely replicating vectors. In other embodiments, the nucleic acids have been integrated into the genome of the host cells and/or into an endogenous plasmid of the host cells. The transformed host cells find use, e.g., in the production of recombinant nutritive proteins disclosed herein.

"Microorganisms" includes prokaryotic and eukaryotic microbial species from the Domains *Archaea, Bacteria* and *Eucarya*, the latter including yeast and filamentous fungi, protozoa, algae, or higher Protista. The terms "microbial cells" and "microbes" are used interchangeably with the term microorganism.

A variety of host microorganisms may be transformed with a nucleic acid sequence disclosed herein and may in some embodiments be used to produce a recombinant nutritive protein disclosed herein. Suitable host microorganisms include both autotrophic and heterotrophic microbes. In some applications the autotrophic microorganisms allows for a reduction in the fossil fuel and/or electricity inputs required to make a nutritive protein encoded by a recombinant nucleic acid sequence introduced into the host microorganism. This, in turn, in some applications reduces the cost and/or the environmental impact of producing the nutritive protein and/or reduces the cost and/or the environmental impact in comparison to the cost and/or environmental impact of manufacturing alternative nutritive proteins, such as whey, egg, and soy. For example, the cost and/or environmental impact of making a nutritive protein disclosed herein using a host microorganism as disclosed herein is in some embodiments lower that the cost and/or environmental impact of making whey protein in a form suitable for human consumption by processing of cows milk.

Non-limiting examples of heterotrophs include *Escherichia coli, Salmonella typhimurium, Bacillus subtilis, Bacillus megaterium, Corynebacterium glutamicum, Streptomyces coelicolor, Streptomyces lividans, Streptomyces vanezuelae, Streptomyces roseosporus, Streptomyces fradiae, Streptomyces griseus, Streptomyces calvuligerus, Streptomyces hygroscopicus, Streptomyces platensis, Saccharopolyspora erythraea, Corynebacterium glutamicum, Aspergillus niger, Aspergillus nidulans, Aspergillus oryzae, Aspergillus terreus, Aspergillus sojae, Penicillium chrysogenum, Trichoderma reesei, Clostridium acetobutylicum, Clostridium beijerinckii, Clostridium thermocellum, Fusibacter paucivorans, Saccharomyces cerevisiae, Saccharomyces boulardii, Pichia pastoris*, and *Pichia stipitis*.

Photoautotrophic microrganisms include eukaryotic algae, as well as prokaryotic cyanobacteria, green-sulfur bacteria, green non-sulfur bacteria, purple sulfur bacteria, and purple non-sulfur bacteria.

Extremophiles are also contemplated as suitable organisms. Such organisms withstand various environmental parameters such as temperature, radiation, pressure, gravity, vacuum, desiccation, salinity, pH, oxygen tension, and chemicals. They include hyperthermophiles, which grow at or above 80° C. such as *Pyrolobus fumarii*; thermophiles, which grow between 60-80° C. such as *Synechococcus lividis*; mesophiles, which grow between 15-60° C.; and psychrophiles, which grow at or below 15° C. such as *Psychrobacter* and some insects. Radiation tolerant organisms include *Deinococcus radiodurans*. Pressure-tolerant organisms include piezophiles, which tolerate pressure of 130 MPa. Weight-tolerant organisms include barophiles. Hypergravity (e.g., >1 g) hypogravity (e.g., <1 g) tolerant organisms are also contemplated. Vacuum tolerant organisms include tardigrades, insects, microbes and seeds. Dessicant tolerant and anhydrobiotic organisms include xerophiles such as *Artemia salina*; nematodes, microbes, fungi and lichens. Salt-tolerant organisms include halophiles (e.g., 2-5 M NaCl) *Halobacteriacea* and *Dunaliella salina*. pH-tolerant organisms include alkaliphiles such as *Natronobacterium, Bacillus firmus* OF4, *Spirulina* spp. (e.g., pH >9) and acidophiles such as *Cyanidium caldarium, Ferroplasma* sp. (e.g., low pH). Anaerobes, which cannot tolerate $O_2$ such as *Methanococcus jannaschii*; microaerophils, which tolerate some $O_2$ such as *Clostridium* and aerobes, which require $O_2$ are also contemplated. Gas-tolerant organisms, which tolerate pure $CO_2$ include *Cyanidium caldarium* and metal tolerant organisms include metalotolerants such as *Ferroplasma acidarmanus* (e.g., Cu, As, Cd, Zn), *Ralstonia* sp. CH34 (e.g., Zn, Co, Cd, Hg, Pb). Gross, Michael. *Life on the Edge: Amazing Creatures Thriving in Extreme Environments*. New York: Plenum (1998) and Seckbach, J. "Search for Life in the Universe with Terrestrial Microbes Which Thrive Under Extreme Conditions." In Cristiano Batalli Cosmovici, Stuart Bowyer, and Dan Wertheimer, eds., *Astronomical and Biochemical Origins and the Search for Life in the Universe*, p. 511. Milan: Editrice Compositori (1997).

Mixotrophic organisms are also suitable organisms. Mixotrophic organisms can utilize a mix of different sources of energy and carbon, for example, photo- and chemotrophy, litho- and organotrophy, auto- and heterotrophy, and combinations thereof or a combination of it. Mixotrophs can be either eukaryotic or prokaryotic. Additionally, mixotrophs can be obligate or facultative. Suitable mixotrophic organisms include mixotrophic algae and mixotrophic bacteria.

Algae and cyanobacteria include but are not limited to the following genera: *Acanthoceras, Acanthococcus, Acaryochloris, Achnanthes, Achnanthidium, Actinastrum, Actinochloris, Actinocyclus, Actinotaenium, Amphichrysis, Amphidinium, Amphikrikos, Amphipleura, Amphiprora, Amphithrix, Amphora, Anabaena, Anabaenopsis, Aneumastus, Ankistrodesmus, Ankyra, Anomoeoneis, Apatococcus, Aphanizomenon, Aphanocapsa, Aphanochaete, Aphanothece, Apiocystis, Apistonema, Arthrodesmus, Artherospira, Ascochloris, Asterionella, Asterococcus, Audouinella, Aulacoseira, Bacillaria, Balbiania, Bambusina, Bangia, Basichlamys, Batrachospermum, Binuclearia, Bitrichia, Blidingia, Botrdiopsis, Botrydium, Botryococcus, Botryosphaerella, Brachiomonas, Brachysira, Brachytrichia, Brebissonia, Bulbochaete, Bumilleria, Bumilleriopsis, Caloneis, Calothrix, Campylodiscus, Capsosiphon, Carteria, Catena, Cavinula, Centritractus, Centronella, Ceratium, Chaetoceros, Chaetochloris, Chaetomorpha, Chaetonella, Chaetonema, Chaetopeltis, Chaetophora, Chaetosphaeridium, Chamaesiphon, Chara, Characiochloris, Characiopsis, Characium, Charales, Chilomonas, Chlainomonas, Chlamydoblepharis, Chlamydocapsa, Chlamydomonas, Chlamydomonopsis, Chlamydomyxa, Chlamydonephris, Chlorangiella, Chlorangiopsis, Chlorella, Chlo-* robotrys, Chlorobrachis, Chlorochytrium, Chlorococcum, Chlorogloea, Chlorogloeopsis, Chlorogonium, Chlorolobion, Chloromonas, Chlorophysema, Chlorophyta, Chlorosaccus, Chlorosarcina, Choricystis, Chromophyton, Chromulina, Chroococcidiopsis, Chroococcus, Chroodactylon, Chroomonas, Chroothece, Chrysamoeba, Chrysapsis, Chrysidiastrum, Chrysocapsa, Chrysocapsella, Chrysochaete, Chrysochromulina, Chrysococcus, Chrysocrinus, Chrysolepidomonas, Chrysolykos, Chrysonebula, Chrysophyta, Chrysopyxis, Chrysosaccus, Chrysophaerella, Chrysostephanosphaera, Clodophora, Clastidium, Closteriopsis, Closterium, Coccomyxa, Cocconeis, Coelastrella, Coelastrum, Coelosphaerium, Coenochloris, Coenococcus, Coenocystis, Colacium, Coleochaete, Collodictyon, Compsogonopsis, Compsopogon, Conjugatophyta, Conochaete, Coronastrum, Cosmarium, Cosmioneis, Cosmocladium, Crateriportula, Craticula, Crinalium, Crucigenia, Crucigeniella, Cryptoaulax, Cryptomonas, Cryptophyta, Ctenophora, Cyanodictyon, Cyanonephron, Cyanophora, Cyanophyta, Cyanothece, Cyanothomonas, Cyclonexis, Cyclostephanos, Cyclotella, Cylindrocapsa, Cylindrocystis, Cylindrospermum, Cylindrotheca, Cymatopleura, Cymbella, Cymbellonitzschia, Cystodinium Dactylococcopsis, Debarya, Denticula, Dermatochrysis, Dermocarpa, Dermocarpella, Desmatractum, Desmidium, Desmococcus, Desmonema, Desmosiphon, Diacanthos, Diacronema, Diadesmis, Diatoma, Diatomella, Dicellula, Dichothrix, Dichotomococcus, Dicranochaete, Dictyochloris, Dictyococcus, Dictyosphaerium, Didymocystis, Didymogenes, Didymosphenia, Dilabifilum, Dimorphococcus, Dinobryon, Dinococcus, Diplochloris, Diploneis, Diplostauron, Distrionella, Docidium, Drapamaldia, Dunaliella, Dysmorphococcus, Ecballocystis, Elakatothrix, Ellerbeckia, Encyonema, Enteromorpha, Entocladia, Entomoneis, Entophysalis, Epichrysis, Epipyxis, Epithemia, Eremosphaera, Euastropsis, Euastrum, Eucapsis, Eucocconeis, Eudorina, Euglena, Euglenophyta, Eunotia, Eustigmatophyta, Eutreptia, Fallacia, Fischerella, Fragilaria, Fragilariforma, Franceia, Frustulia, Curcilla, Geminella, Genicularia, Glaucocystis, Glaucophyta, Glenodiniopsis, Glenodinium, Gloeocapsa, Gloeochaete, Gloeochrysis, Gloeococcus, Gloeocystis, Gloeodendron, Gloeomonas, Gloeoplax, Gloeothece, Gloeotila, Gloeotrichia, Gloiodictyon, Golenkinia, Golenkiniopsis, Gomontia, Gomphocymbella, Gomphonema, Gomphosphaeria, Gonatozygon, Gongrosia, Gongrosira, Goniochloris, Gonium, Gonyostomum, Granulochloris, Granulocystopsis, Groenbladia, Gymnodinium, Gymnozyga, Gyrosigma, Haematococcus, Hafniomonas, Hallassia, Hammatoidea, Hannaea, Hantzschia, Hapalosiphon, Haplotaenium, Haptophyta, Haslea, Hemidinium, Hemitoma, Heribaudiella, Heteromastix, Heterothrix, Hibberdia, Hildenbrandia, Hillea, Holopedium, Homoeothrix, Hormanthonema, Hormotila, Hyalobrachion, Hyalocardium, Hyalodiscus, Hyalogonium, Hyalotheca, Hydrianum, Hydrococcus, Hydrocoleum, Hydrocoryne, Hydrodictyon, Hydrosera, Hydrurus, Hyella, Hymenomonas, Isthmochloron, Johannesbaptistia, Juranyiella, Karayevia, Kathablepharis, Katodinium, Kephyrion, Keratococcus, Kirchneriella, Klebsormidium, Kolbesia, Koliella, Komarekia, Korshikoviella, Kraskella, Lagerheimia, Lagynion, Lamprothamnium, Lemanea, Lepocinclis, Leptosira, Lobococcus, Lobocystis, Lobomonas, Luticola, Lyngbya, Malleochloris, Mallomonas, Mantoniella, Marssoniella, Martyana, Mastigocoleus, Gastogloia, Melosira, Merismopedia, Mesostigma, Mesotaenium, Micractinium, Micrasterias, Microchaete, Microcoleus, Microcystis, Microglena, Micromonas, Microspora, Microthamnion, Mischococcus, Monochrysis, Monodus, Monomastix, Monoraphidium, Monostroma, Mougeotia, Mougeotiopsis, Myochloris, Myromecia, Myxosarcina, Naegeliella, Nannochloris, Nautococcus, Navicula, Neglectella, Neidium, Nephroclamys, Nephrocytium, Nephrodiella, Nephroselmis, Netrium, Nitella, Nitellopsis, Nitzschia, Nodularia, Nostoc, Ochromonas, Oedogonium, Oligochaetophora, Onychonema, Oocardium, Oocystis, Opephora, Ophiocytium, Orthoseira, Oscillatoria, Oxyneis, Pachycladella, Palmella, Palmodictyon, Pnadorina, Pannus, Paralia, Pascherina, Paulschulzia, Pediastrum, Pedinella, Pedinomonas, Pedinopera, Pelagodictyon, Penium, Peranema, Peridiniopsis, Peridinium, Peronia, Petroneis, Phacotus, Phacus, Phaeaster, Phaeodermatium, Phaeophyta, Phaeosphaera, Phaeothamnion, Phormidium, Phycopeltis, Phyllariochloris, Phyllocardium, Phyllomitas, Pinnularia, Pitophora, Placoneis, Planctonema, Planktosphaeria, Planothidium, Plectonema, Pleodorina, Pleurastrum, Pleurocapsa, Pleurocladia, Pleurodiscus, Pleurosigma, Pleurosira, Pleurotaenium, Pocillomonas, Podohedra, Polyblepharides, Polychaetophora, Polyedriella, Polyedriopsis, Polygoniochloris, Polyepidomonas, Polytaenia, Polytoma, Polytomella, Porphyridium, Posteriochromonas, Prasinochloris, Prasinocladus, Prasinophyta, Prasiola, Prochlorphyta, Prochlorothrix, Protoderma, Protosiphon, Provasoliella, Prymnesium, Psammodictyon, Psammothidium, Pseudanabaena, Pseudenoclonium, Psuedocarteria, Pseudochate, Pseudocharacium, Pseudococcomyxa, Pseudodictyosphaerium, Pseudokephyrion, Pseudoncobyrsa, Pseudoquadrigula, Pseudosphaerocystis, Pseudostaurastrum, Pseudostaurosira, Pseudotetrastrum, Pteromonas, Punctastruata, Pyramichlamys, Pyramimonas, Pyrrophyta, Quadrichloris, Quadricoccus, Quadrigula, Radiococcus, Radiofilum, Raphidiopsis, Raphidocelis, Raphidonema, Raphidophyta, Peimeria, Rhabdoderma, Rhabdomonas, Rhizoclonium, Rhodomonas, Rhodophyta, Rhoicosphenia, Rhopalodia, Rivularia, Rosenvingiella, Rossithidium, Roya, Scenedesmus, Scherffelia, Schizochlamydella, Schizochlamys, Schizomeris, Schizothrix, Schroederia, Scolioneis, Scotiella, Scotiellopsis, Scourfieldia, Scytonema, Selenastrum, Selenochloris, Sellaphora, Semiorbis, Siderocelis, Diderocystopsis, Dimonsenia, Siphononema, Sirocladium, Sirogonium, Skeletonema, Sorastrum, Spennatozopsis, Sphaerellocystis, Sphaerellopsis, Sphaerodinium, Sphaeroplea, Sphaerozosma, Spiniferomonas, Spirogyra, Spirotaenia, Spirulina, Spondylomorum, Spondylosium, Sporotetras, Spumella, Staurastrum, Stauerodesmus, Stauroneis, Staurosira, Staurosirella, Stenopterobia, Stephanocostis, Stephanodiscus, Stephanoporos, Stephanosphaera, Stichococcus, Stichogloea, Stigeoclonium, Stigonema, Stipitococcus, Stokesiella, Strombomonas, Stylochrysalis, Stylodinium, Styloyxis, Stylosphaeridium, Surirella, Sykidion, Symploca, Synechocystis, Synechocystis, Synedra, Synochromonas, Synura, Tabellaria, Tabularia, Teilingia, Temnogametum, Tetmemorus, Tetrachlorella, Tetracyclus, Tetradesmus, Tetraedriella, Tetraedron, Tetraselmis, Tetraspora, Tetrastrum, Thalassiosira, Thamniochaete, Thorakochloris, Thorea, Tolypella, Tolypothrix, Trachelomonas, Trachydiscus, Trebouxia, Trentepholia, Treubaria, Tribonema, Trichodesmium, Trichodiscus, Trochiscia, Tryblionella, Ulothrix, Uroglena, Uronema, Urosolenia, Urospora, Uva, Vacuolaria, Vaucheria, Volvox, Volvulina, Westella, Woloszynskia, Xanthidium, Xanthophyta, Xenococcus, Zygnema, Zygnemopsis, and Zygonium.

Additional cyanobacteria include members of the genus Chamaesiphon, Chroococcus, Cyanobacterium, Cyanobium, Cyanothece, Dactylococcopsis, Gloeobacter, Gloeo-

*capsa, Gloeothece, Microcystis, Prochlorococcus, Prochloron, Synechococcus, Synechocystis, Cyanocystis, Dermocarpella, Stanieria, Xenococcus, Chroococcidiopsis, Myxosarcina, Arthrospira, Borzia, Crinalium, Geitlerinemia, Leptolyngbya, Limnothrix, Lyngbya, Microcoleus, Oscillatoria, Planktothrix, Prochlorothrix, Pseudanabaena, Spirulina, Starria, Symploca, Trichodesmium, Tychonema, Anabaena, Anabaenopsis, Aphanizomenon, Cyanospira, Cylindrospermopsis, Cylindrospermum, Nodularia, Nostoc, Scylonema, Calothrix, Rivularia, Tolypothrix, Chlorogloeopsis, Fischerella, Geitieria, Iyengariella, Nostochopsis, Stigonema* and *Thermosynechococcus*.

Green non-sulfur bacteria include but are not limited to the following genera: *Chloroflexus, Chloronema, Oscillochloris, Heliothrix, Herpetosiphon, Roseiflexus*, and *Thermomicrobium*.

Green sulfur bacteria include but are not limited to the following genera: *Chlorobium, Clathrochloris*, and *Prosthecochloris*.

Purple sulfur bacteria include but are not limited to the following genera: *Allochromatium, Chromatium, Halochromatium, Isochromatium, Marichromatium, Rhodovulum, Thermochromatium, Thiocapsa, Thiorhodococcus*, and *Thiocystis*.

Purple non-sulfur bacteria include but are not limited to the following genera: *Phaeospirillum, Rhodobaca, Rhodobacter, Rhodomicrobium, Rhodopila, Rhodopseudomonas, Rhodothalassium, Rhodospirillum, Rodovibrio*, and *Roseospira*.

Aerobic chemolithotrophic bacteria include but are not limited to nitrifying bacteria such as *Nitrobacteraceae* sp., *Nitrobacter* sp., *Nitrospina* sp., *Nitrococcus* sp., *Nitrospira* sp., *Nitrosomonas* sp., *Nitrosococcus* sp., *Nitrosospira* sp., *Nitrosolobus* sp., *Nitrosovibrio* sp.; colorless sulfur bacteria such as, *Thiovulum* sp., *Thiobacillus* sp., *Thiomicrospira* sp., *Thiosphaera* sp., *Thermothrix* sp.; obligately chemolithotrophic hydrogen bacteria such as *Hydrogenobacter* sp., iron and manganese-oxidizing and/or depositing bacteria such as *Siderococcus* sp., and magnetotactic bacteria such as *Aquaspirillum* sp.

Archaeobacteria include but are not limited to methanogenic archaeobacteria *such as Methanobacterium* sp., *Methanobrevibacter* sp., *Methanothermus* sp., *Methanococcus* sp., *Methanomicrobium* sp., *Methanospirillum* sp., *Methanogenium* sp., *Methanosarcina* sp., *Methanolobus* sp., *Methanothrix* sp., *Methanococcoides* sp., *Methanoplanus* sp.; extremely thermophilic S-Metabolizers such as *Thermoproteus* sp., *Pyrodictium* sp., *Sulfolobus* sp., *Acidianus* sp. and other microorganisms such as, *Bacillus subtilis, Saccharomyces cerevisiae, Streptomyces* sp., *Ralstonia* sp., *Rhodococcus* sp., *Corynebacteria* sp., *Brevibacteria* sp., *Mycobacteria* sp., *and oleaginous yeast.*

Yet other suitable organisms include synthetic cells or cells produced by synthetic genomes as described in Venter et al. US Pat. Pub. No. 2007/0264688, and cell-like systems or synthetic cells as described in Glass et al. US Pat. Pub. No. 2007/0269862.

Still other suitable organisms include *Escherichia coli, Acetobacter aceti, Bacillus subtilis*, yeast and fungi such as *Clostridium ljungdahlii, Clostridium thermocellum, Penicillium chrysogenum, Pichia pastoris, Saccharomyces cerevisiae, Schizosaccharomyces pombe, Pseudomonas fluorescens*, or *Zymomonas mobilis*. In some embodiments those organisms are engineered to fix carbon dioxide while in other embodiments they are not.

In some embodiments eukaryotic cells, such as insect cells or mammalian cells, such as human cells are used as host cells. Vectors and expression control sequences including promoters and enhancers are well known for such cells. Examples of useful mammalian host cell lines for this purpose are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/–DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

F. Production of Nutritive Proteins

Skilled artisans are aware of many suitable methods available for culturing recombinant cells to produce (and optionally secrete) a recombinant nutritive protein as disclosed herein, as well as for purification and/or isolation of expressed recombinant proteins. The methods chosen for protein purification depend on many variables, including the properties of the protein of interest, its location and form within the cell, the vector, host strain background, and the intended application for the expressed protein. Culture conditions can also have an effect on solubility and localization of a given target protein. Many approaches can be used to purify target proteins expressed in recombinant microbial cells as disclosed herein, including without limitation ion exchange and gel filtration.

In some embodiments a peptide fusion tag is added to the recombinant protein making possible a variety of affinity purification methods that take advantage of the peptide fusion tag. In some embodiments, the use of an affinity method enables the purification of the target protein to near homogeneity in one step. Purification may include cleavage of part or all of the fusion tag with enterokinase, factor Xa, thrombin, or HRV 3C proteases, for example. In some embodiments, before purification or activity measurements of an expressed target protein, preliminary analysis of expression levels, cellular localization, and solubility of the target protein is performed. The target protein may be found in any or all of the following fractions: soluble or insoluble cytoplasmic fractions, periplasm, or medium. Depending on the intended application, preferential localization to inclusion bodies, medium, or the periplasmic space can be advantageous, in some embodiments, for rapid purification by relatively simple procedures.

While *Escherichia coli* is widely regarded as a robust host for heterologous protein expression, it is also widely known that over-expression of many proteins in this host is prone to aggregation in the form of insoluble inclusion bodies. One of the most commonly used methods for either rescuing inclusion body formation, or to improve the titer of the protein itself, is to include an amino-terminal maltose-binding protein (MBP) [Austin B P, Nallamsetty S, Waugh D S. Hexahistidine-tagged maltose-binding protein as a fusion partner for the production of soluble recombinant proteins in *Escherichia coli*. Methods Mol Biol. 2009; 498:157-72], or small ubiquitin-related modifier (SUMO) [Saitoh H, Uwada J, Azusa K. Strategies for the expression of SUMO-modified target proteins in *Escherichia coli*.

*Methods Mol Biol.* 2009; 497:211-21; Malakhov M P, Mattern M R, Malakhova O A, Drinker M, Weeks S D, Butt T R. SUMO fusions and SUMO-specific protease for efficient expression and purification of proteins. J Struct Funct Genomics. 2004; 5(1-2):75-86; Panavas T, Sanders C, Butt T R. SUMO fusion technology for enhanced protein production in prokaryotic and eukaryotic expression systems. Methods Mol Biol. 2009; 497:303-17] fusion to the protein of interest. These two proteins are expressed extremely well, and in the soluble form, in *Escherichia coli* such that the protein of interest is also effectively produced in the soluble form. The protein of interest can be cleaved by designing a site specific protease recognition sequence (such as the tobacco etch virus (TEV) protease) in-between the protein of interest and the fusion protein [1].

In some embodiments the recombinant protein is initially not folded correctly or is insoluble. A variety of methods are well known for refolding of insoluble proteins. Most protocols comprise the isolation of insoluble inclusion bodies by centrifugation followed by solubilization under denaturing conditions. The protein is then dialyzed or diluted into a non-denaturing buffer where refolding occurs. Because every protein possesses unique folding properties, the optimal refolding protocol for any given protein can be empirically determined by a skilled artisan. Optimal refolding conditions can, for example, be rapidly determined on a small scale by a matrix approach, in which variables such as protein concentration, reducing agent, redox treatment, divalent cations, etc., are tested. Once the optimal concentrations are found, they can be applied to a larger scale solubilization and refolding of the target protein.

In some embodiments the nutritive protein does not comprise a tertiary structure. In some embodiments less than half of the amino acids in the nutritive protein participate in a tertiary structure. In some embodiments the nutritive protein does not comprise a secondary structure. In some embodiments less than half of the amino acids in the nutritive protein participate in a secondary structure. Recombinant nutritive proteins may be isolated from a culture of cells expressing them in a state that comprises one or more of these structural features. In some embodiments the tertiary structure of a recombinant nutritive protein is reduced or eliminated after the protein is isolated from a culture producing it. In some embodiments the secondary structure of a recombinant nutritive protein is reduced or eliminated after the protein is isolated from a culture producing it.

In some embodiments a CAPS buffer at alkaline pH in combination with N-lauroylsarcosine is used to achieve solubility of the inclusion bodies, followed by dialysis in the presence of DTT to promote refolding. Depending on the target protein, expression conditions, and intended application, proteins solubilized from washed inclusion bodies may be >90% homogeneous and may not require further purification. Purification under fully denaturing conditions (before refolding) is possible using His•Tag® fusion proteins and His•Bind® immobilized metal affinity chromatography (Novogen®). In addition, S•Tag™, T7•Tag®, and Strep•Tag® II fusion proteins solubilized from inclusion bodies using 6 M urea can be purified under partially denaturing conditions by dilution to 2 M urea (S•Tag and T7•Tag) or 1 M urea (Strep•Tag II) prior to chromatography on the appropriate resin. Refolded fusion proteins can be affinity purified under native conditions using His•Tag, S•Tag, Strep•Tag II, and other appropriate affinity tags (e.g., GST•Tag™, and T7•Tag) (Novogen®).

In some embodiments the recombinant nutritive protein is an endogenous protein of the host cell used to express it. That is, the cellular genome of the host cell comprises an open reading frame that encodes the recombinant nutritive protein. In some embodiments regulatory sequences sufficient to increase expression of the nutritive protein are inserted into the host cell genome and operatively linked to the endogenous open reading frame such that the regulatory sequences drive overexpression of the recombinant nutritive protein from a recombinant nucleic acid. In some embodiments heterologous nucleic acid sequences are fused to the endogenous open reading frame of the nutritive protein and cause the nutritive protein to be synthesized comprising a heterologous amino acid sequence that changes the cellular trafficking of the recombinant nutritive protein, such as directing it to an organelle or to a secretion pathway. In some embodiments an open reading frame that encodes the endogeneous host cell protein is introduced into the host cell on a plasmid that further comprises regulatory sequences operatively linked to the open reading frame. In some embodiments the recombinant host cell expresses at least 2 times, at least 3 times, at least 4 times, at least 5 times, at least 10 times, or at least 20 times, at least 30 times, at least 40 times, at least 50 times, or at least 100 times more of the recombinant nutritive protein than the amount of the nutritive protein produced by a similar host cell grown under similar conditions.

In some embodiments nutritive proteins of this disclosure are synthesized chemically without the use of a recombinant production system. Protein synthesis can be carried out in a liquid-phase system or in a solid-phase system using techniques known in the art (see, e.g., Atherton, E., Sheppard, R. C. (1989). Solid Phase peptide synthesis: a practical approach. Oxford, England: IRL Press; Stewart, J. M., Young, J. D. (1984). Solid phase peptide synthesis (2nd ed.). Rockford: Pierce Chemical Company.

G. Production of Recombinant Nutritive Proteins in Plants

The nucleic acid molecules comprising a nucleic acid sequence encoding a nutritive protein of this disclosure enable production of transgenic plants comprising the nucleic acid sequence. Accordingly, this disclosure also provides plant comprising a recombinant nucleic acid molecule comprising a nucleic acid sequence encoding a nutritive protein of this disclosure. The plant can be any plant that is subject to transformation and regeneration and include, but are not limited to, Acacia, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassava, cauliflower, celery, Chinese cabbage, cherry, cilantro, citrus, clementines, coffee, corn, cotton, cucumber, Douglas fir, eggplant, endive, escarole, eucalyptus, fennel, figs, forest trees, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, rapeseed, raspberry, rice, rye, sorghum, Southern pine, soybean, spinach, squash, strawberry, sugarbeet, sugarcane, sunflower, sweet corn, sweet potato, sweetgum, tangerine, tea, tobacco, tomato, turf, a vine, watermelon, wheat, yams, and zucchini. In preferred embodiments, the plant is a bean, broccoli, cabbage, canola, carrot, cauliflower, celery, Chinese cabbage, corn, cotton cucumber, eggplant, leek, lettuce, melon, pea, pepper, pumpkin, radish, spinach, soybean, squash, sugarcane, sweet corn, tomato, watermelon, and wheat plant. In some embodiments, the plant is a corn plant.

In some embodiments, the plant is a soybean plant. In some embodiments, the plant is a cotton plant. In some embodiments, the plant is a canola plant. In some embodiments the plant is a member of a genus selected from Arabidopsis, Beta, Glycine, Jatropha, Miscanthus, Panicum, Phalaris, Populus, Saccharum, Salix, Simmondsia and Zea.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of Agrobacterium tumefaciens, caulimovirus promoters such as the cauliflower mosaic virus. For instance, see U.S. Pat. Nos. 5,858,742 and 5,322,938, which disclose versions of the constitutive promoter derived from cauliflower mosaic virus (CaMV35S), U.S. Pat. No. 5,641,876, which discloses a rice actin promoter, U.S. Patent Application Publication 2002/0192813A1, which discloses 5',3' and intron elements useful in the design of effective plant expression vectors, U.S. patent application Ser. No. 09/757,089, which discloses a maize chloroplast aldolase promoter, U.S. patent application Ser. No. 08/706,946, which discloses a rice glutelin promoter, U.S. patent application Ser. No. 09/757,089, which discloses a maize aldolase (FDA) promoter, and U.S. patent application Ser. No. 60/310,370, which discloses a maize nicotianamine synthase promoter. These and numerous other promoters that function in plant cells are known to those skilled in the art and available for use in recombinant nucleic acids to provide for expression of nutritive proteins in transgenic plants.

For some applications preferential expression in plant green tissues is desired. Promoters of interest for such uses include those from genes such as Arabidopsis thaliana ribulose-1,5-bisphosphate carboxylase (Rubisco) small subunit (Fischhoff et al. (1992) Plant Mol. Biol. 20:81-93), aldolase and pyruvate orthophosphate dikinase (PPDK) (Taniguchi et al. (2000) Plant Cell Physiol. 41(1):42-48).

Furthermore, the promoters may be altered to contain at least one enhancer sequence to assist in elevating gene expression. Such enhancers are known in the art. By including an enhancer sequence with such constructs, the expression of the nutrive protein may be enhanced. These enhancers are often found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

For some applications expression in plant seed tissues is desired to effect modify seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) Transgenic Res. 6(2):157-166), globulin 1 (Belanger et al (1991) Genetics 129:863-872), glutelin 1 (Russell (1997) supra), and peroxiredoxin antioxidant (Per1) (Stacy et al. (1996) Plant Mol. Biol. 31(6): 1205-1216)

Recombinant nucleic acid constructs prepared in accordance with the disclosure will also generally include a 3' element that typically contains a polyadenylation signal and site. Well-known 3' elements include those from Agrobacterium tumefaciens genes such as nos 3', tml 3', tmr 3', tms 3', ocs 3', tr7 3', for example disclosed in U.S. Pat. No. 6,090,627; 3' elements from plant genes such as wheat (Triticum aesevitum) heat shock protein 17 (Hsp17 3'), a wheat ubiquitin gene, a wheat fructose-1,6-biphosphatase gene, a rice glutelin gene a rice lactate dehydrogenase gene and a rice beta-tubulin gene, all of which are disclosed in U.S. published patent application 2002/0192813 A1; and the pea (Pisum sativum) ribulose biphosphate carboxylase gene (rbs 3'), and 3' elements from the genes within the host plant.

Constructs and vectors may also include a transit peptide for targeting of a gene target to a plant organelle, particularly to a chloroplast, leucoplast or other plastid organelle. For descriptions of the use of chloroplast transit peptides see U.S. Pat. No. 5,188,642 and U.S. Pat. No. 5,728,925. For description of the transit peptide region of an Arabidopsis EPSPS gene, see Klee, H. J. et al (MGG (1987) 210:437-442).

Numerous methods for transforming plant cells with recombinant DNA are known in the art and may be used in the present disclosure. Two commonly used methods for plant transformation are Agrobacterium-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and Agrobacterium-mediated transformation is described in U.S. Pat. No. 5,159,135 (cotton); U.S. Pat. No. 5,824,877 (soybean); U.S. Pat. No. 5,591,616 (corn); and U.S. Pat. No. 6,384,301 (soybean). For Agrobacterium tumefaciens based plant transformation system, additional elements present on transformation constructs will include T-DNA left and right border sequences to facilitate incorporation of the recombinant polynucleotide into the plant genome.

In general it is useful to introduce recombinant DNA randomly, i.e. at a non-specific location, in the genome of a target plant line. In special cases it may be useful to target recombinant DNA insertion in order to achieve site-specific integration, for example to replace an existing gene in the genome, to use an existing promoter in the plant genome, or to insert a recombinant polynucleotide at a predetermined site known to be active for gene expression. Several site specific recombination systems exist which are known to function in plants, including cre-lox as disclosed in U.S. Pat. No. 4,959,317 and FLP-FRT as disclosed in U.S. Pat. No. 5,527,695.

Transformation methods are generally practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, seedling apical meristems, microspores and the like. Cells capable of proliferating as callus are also recipient cells for genetic transformation. Practical transformation methods and materials for making transgenic plants of this disclosure, for example various media and recipient target cells, transformation of immature embryo cells and subsequent regeneration of fertile transgenic plants are disclosed in U.S. Pat. Nos. 6,194,636 and 6,232,526.

The seeds of transgenic plants can be harvested from fertile transgenic plants and used to grow progeny generations of transformed plants that produce the recombinant nutritive protein of this disclosure. In addition to direct transformation of a plant with a recombinant DNA, transgenic plants can be prepared by crossing a first plant having a recombinant DNA with a second plant lacking the DNA. For example, recombinant DNA can be introduced into first plant line that is amenable to transformation to produce a transgenic plant which can be crossed with a second plant line to introgress the recombinant DNA into the second plant line. A transgenic plant with recombinant DNA encoding a nutritive protein of this disclosure, can be crossed with transgenic plant line having other recombinant DNA that confers another trait, for example herbicide resistance or pest resistance, or production of a second nutritive product such as an oil, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In the practice of transformation DNA is typically introduced into only a small percentage of target plant cells in any one transformation experiment. Marker genes are used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the herbicides to which the transformed plants may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV) and gentamycin (aac3 and aacC4) or resistance to herbicides such as glufosinate (bar or pat) and glyphosate (aroA or EPSPS). Examples of such selectable are illustrated in U.S. Pat. Nos. 5,550,318; 5,633,435; 5,780,708 and 6,118,047. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber. Plants are regenerated from about 6 weeks to 10 months after a transformant is identified, depending on the initial tissue. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of a heterologous nutritive protein.

Transgenic plants derived from the plant cells of this disclosure are grown to generate transgenic plants comprising the heterologous nucleic acid that encodes a nutritive protein of this disclosure and produce transgenic seed and haploid pollen comprising the heterologous nucleic acid sequence. Such plants with enhanced traits are identified by selection of transformed plants or progeny seed for the enhanced trait. Transgenic plants grown from transgenic seed provided herein demonstrate improved agronomic traits that contribute to increased yield or other traits that provide increased plant value, including, for example, improved protein quality such as increasing the content of at least one of essential amino acids, branch chain amino acids, or Leu.

The transgenic plants are useful as sources of nutritive proteins. For example, in some embodiments a transgenic plant comprising a recombinant nutritive protein of this disclosure comprises an increased weight fraction of total protein compared to a control non-transgenic plant. In some embodiments a transgenic plant comprising a recombinant nutritive protein of this disclosure comprises an increased weight fraction of essential amino acids compared to a control non-transgenic plant. In some embodiments a transgenic plant comprising a recombinant nutritive protein of this disclosure comprises an increased weight fraction of branch chain amino acids compared to a control non-transgenic plant. In some embodiments a transgenic plant comprising a recombinant nutritive protein of this disclosure comprises an increased weight fraction of Leu compared to a control non-transgenic plant. In some embodiments a transgenic plant comprising a recombinant nutritive protein of this disclosure comprises at least one of: a) an increased ratio of branch chain amino acid residues to total amino acid residues compared to a control non-transgenic plant; b) an increased ratio of Leu residues to total amino acid residues compared to a control non-transgenic plant; and c) an increased ratio of essential amino acid residues to total amino acid residues compared to a control non-transgenic plant. In some embodiments a transgenic plant comprising a recombinant nutritive protein of this disclosure comprises: a) an increased ratio of branch chain amino acid residues to total amino acid residues compared to a control non-transgenic plant; b) an increased ratio of Leu residues to total amino acid residues compared to a control non-transgenic plant; and c) an increased ratio of essential amino acid residues to total amino acid residues compared to a control non-transgenic plant.

Accordingly, the transgenic plants are useful as sources of high quality protein. The plants may be harvested and used in mammalian diets with or without further processing. For example, flour made from transgenic wheat, cornmeal made from transgenic corn, or rice or rice flour derived from transgenic rice is enriched in at least one of protein, essential amino acids, branch chain amino acids, and Leu compared to similar products made from plants that do not comprise the recombinant nutritive protein. In some embodiments the recombinant nutritive protein is a plant protein or comprises a polypeptide sequence of a plant protein or a derivative or mutein thereof, such as but not necessarily a protein or polypeptide sequence of the same type of plant. In other embodiments the recombinant nutritive protein is not a plant protein or a derivative or mutein thereof.

In some embodiments the recombinant nutritive protein is recovered or partially recovered from the transgenic plant before it is consumed by a mammal.

H. Compositions

At least one nutritive protein disclosed herein may be combined with at least one second component to form a nutritive composition. In some embodiments the only source of amino acid in the composition is the at least one nutritive protein disclosed herein. In such embodiments the amino acid composition of the composition will be the same as the amino acid composition of the at least one nutritive protein disclosed herein. In some embodiments the composition comprises at least one nutritive protein disclosed herein and at least one second protein. In some embodiments the at least one second protein is a second nutritive protein disclosed herein, while in other embodiments the at least one second protein is not a nutritive protein disclosed herein. In some embodiments the composition comprises 1, 2, 3, 4, 5, 6, 7, 8, 9, 10, 11, 12, 13, 14, 15, 16, 17, 18, 19, 20 or more nutritive proteins disclosed herein. In some embodiments the composition comprises 0, 1, 2, 3, 4, 5, 6, 7, 8, 9, 10, 11, 12, 13, 14, 15, 16, 17, 18, 19, 20 or more proteins that are not nutritive proteins disclosed herein. In some embodiments the composition comprises 1, 2, 3, 4, 5, 6, 7, 8, 9, 10, 11, 12, 13, 14, 15, 16, 17, 18, 19, 20 or more nutritive proteins and the composition comprises 0, 1, 2, 3, 4, 5, 6, 7, 8, 9, 10, 11, 12, 13, 14, 15, 16, 17, 18, 19, 20 or more proteins that are not nutritive proteins disclosed herein.

In some embodiments the nutritive composition as described in the preceding paragraph, further comprises at least one of at least one polypeptide, at least one peptide, and at least one free amino acid. In some embodiments the nutritive composition comprises at least one polypeptide and at least one peptide. In some embodiments the nutritive composition comprises at least one polypeptide and at least one free amino acid. In some embodiments the nutritive composition comprises at least one peptide and at least one free amino acid. In some embodiments the at least one polypeptide, at least one peptide, and/or at least one free amino acid comprises amino acids selected from 1) branch chain amino acids, 2) leucine, and 3) essential amino acids. In some embodiments the at least one polypeptide, at least one peptide, and/or at least one free amino acid consists of amino acids selected from 1) branch chain amino acids, 2) leucine, and 3) essential amino acids. In some embodiments, the nutritive composition comprises at least one modified amino acid or a non-standard amino acid. Modified amino acids include amino acids that have modifications to one or more of the carboxy terminus, amino terminus, and/or side chain. Non-standard amino acids may be selected from those that are formed by post-translational modification of proteins, for example, carboxylated glutamate, hydroxyproline, or hypusine. Other non-standard amino acids are not found in proteins. Examples include lanthionine, 2-aminoisobutyric acid, dehydroalanine, gamma-aminobutyric acid, ornithine and citrulline. In some embodiments, the nutritive composition comprises one or more D-amino acids. In some embodiments, the nutritive composition comprises one or more L-amino acids. In some embodiments, the nutritive composition comprises a mixture of one or more D-amino acids and one or more L-amino acids.

By adding at least one of a polypeptide, a peptide, and a free amino acid to a nutritive composition the proportion of at least one of branch chain amino acids, leucine, and essential amino acids, to total amino acid, present in the composition can be increased.

In some embodiments the composition comprises at least one carbohydrate. A "carbohydrate" refers to a sugar or polymer of sugars. The terms "saccharide," "polysaccharide," "carbohydrate," and "oligosaccharide" may be used interchangeably. Most carbohydrates are aldehydes or ketones with many hydroxyl groups, usually one on each carbon atom of the molecule. Carbohydrates generally have the molecular formula $C_nH_{2n}O_n$. A carbohydrate may be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments the composition comprises at least one lipid. As used herein a "lipid" includes fats, oils, triglycerides, cholesterol, phospholipids, fatty acids in any form including free fatty acids. Fats, oils and fatty acids may be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments the composition comprises at least one supplemental vitamin. The at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments the composition comprises at least one organism. Suitable examples are well known in the art and include probiotics (e.g., species of *Lactobacillus* or *Bifidobacterium*), *spirulina, chlorella*, and *porphyra*.

In some embodiments the composition comprises at least one dietary supplement. Suitable examples are well known in the art and include herbs, botanicals, and certain hormones. Non limiting examples include ginko, gensing, and melatonin.

In some embodiments the composition comprises an excipient. Non-limiting examples of suitable excipients include a buffering agent, a preservative, a stabilizer, a binder, a compaction agent, a lubricant, a dispersion enhancer, a disintegration agent, a flavoring agent, a sweetener, a coloring agent.

In some embodiments the excipient is a buffering agent. Non-limiting examples of suitable buffering agents include sodium citrate, magnesium carbonate, magnesium bicarbonate, calcium carbonate, and calcium bicarbonate.

In some embodiments the excipient comprises a preservative. Non-limiting examples of suitable preservatives include antioxidants, such as alpha-tocopherol and ascorbate, and antimicrobials, such as parabens, chlorobutanol, and phenol.

In some embodiments the composition comprises a binder as an excipient. Non-limiting examples of suitable binders include starches, pregelatinized starches, gelatin, polyvinylpyrrolidone, cellulose, methylcellulose, sodium carboxymethylcellulose, ethylcellulose, polyacrylamides, polyvinyloxoazolidone, polyvinylalcohols, C12-C18 fatty acid alcohol, polyethylene glycol, polyols, saccharides, oligosaccharides, and combinations thereof.

In some embodiments the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, micro-crystalline cellulose, alginates, sodium starch glycolate, gums such as agar, guar, locust bean, karaya, pecitin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments the excipient comprises a flavoring agent. Flavoring agents incorporated into the outer layer can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; eucalyptus; vanilla; citrus oil such as lemon oil, orange oil, grape and grapefruit oil; and fruit essences including apple, peach, pear, strawberry, raspberry, cherry, plum, pineapple, and apricot.

In some embodiments the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2,2-dioxide, particularly the potassium salt (acesulfame-K), and sodium and calcium salts thereof.

In some embodiments the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

The weight fraction of the excipient or combination of excipients in the formulation is usually about 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the amino acids in the composition.

The nutritive proteins and nutritive compositions disclosed herein can be formulated into a variety of forms and administered by a number of different means. The compositions can be administered orally, rectally, or parenterally, in formulations containing conventionally acceptable carriers, adjuvants, and vehicles as desired. The term "parenteral" as used herein includes subcutaneous, intravenous, intramuscular, or intrasternal injection and infusion techniques. In an exemplary embodiment, the nutritive protein or composition is administered orally.

Solid dosage forms for oral administration include capsules, tablets, caplets, pills, troches, lozenges, powders, and granules. A capsule typically comprises a core material comprising a nutritive protein or composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as taste-masking agents.

Tablets, pills, and the like can be compressed, multiply compressed, multiply layered, and/or coated. The coating can be single or multiple. In one embodiment, the coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments the coating material comprises a protein. In some embodiments the coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments the coating material comprises at least one edible wax. The edible wax can be derived from animals, insects, or plants. Non-limiting examples include beeswax, lanolin, bayberry wax, carnauba wax, and rice bran wax. Tablets and pills can additionally be prepared with enteric coatings.

Alternatively, powders or granules embodying the nutritive proteins and nutritive compositions disclosed herein can be incorporated into a food product. In some embodiments the food product is be a drink for oral administration. Non-limiting examples of a suitable drink include fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, creams, pastes, emulsions, suspensions and slurries, each of which may optionally also containing at least one of suitable solvents, preservatives, emulsifying agents, suspending agents, diluents, sweeteners, coloring agents, and flavoring agents.

In some embodiments the food product is a solid foodstuff. Suitable examples of a solid foodstuff include without limitation a food bar, a snack bar, a cookie, a brownie, a muffin, a cracker, a biscuit, a cream or paste, an ice cream bar, a frozen yogurt bar, and the like.

In some embodiments, the nutritive proteins and nutritive compositions disclosed herein are incorporated into a therapeutic food. In some embodiments, the therapeutic food is a ready-to-use food that optionally contains some or all essential macronutrients and micronutrients. In some embodiments, the nutritive proteins and nutritive compositions disclosed herein are incorporated into a supplementary food that is designed to be blended into an existing meal. In some embodiments, the supplemental food contains some or all essential macronutrients and micronutrients. In some embodiments, the nutritive proteins and nutritive compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

The compositions disclosed herein can be utilized in methods to increase at least one of muscle mass, strength and physical function, thermogenesis, metabolic expenditure, satiety, mitochondrial biogenesis, weight or fat loss, and lean body composition for example.

I. Methods of Use

In some embodiments the nutritive proteins and nutritive compositions disclosed herein are administered to a patient or a user (sometimes collectively referred to as a "subject"). As used herein "administer" and "administration" encompasses embodiments in which one person directs another to consume a nutritive protein or nutritive composition in a certain manner and/or for a certain purpose, and also situations in which a user uses a nutritive protein or nutritive composition in a certain manner and/or for a certain purpose independently of or in variance to any instructions received from a second person. Non-limiting examples of embodiments in which one person directs another to consume a nutritive protein or nutritive composition in a certain manner and/or for a certain purpose include when a physician prescribes a course of conduct and/or treatment to a patient, when a trainer advises a user (such as an athlete) to follow a particular course of conduct and/or treatment, and when a manufacturer, distributor, or marketer recommends conditions of use to an end user, for example through advertisements or labeling on packaging or on other materials provided in association with the sale or marketing of a product.

In some embodiments the nutritive proteins or nutritive compositions are provided in a dosage form. In some embodiments the dosage form is designed for administration of at least one nutritive protein disclosed herein, wherein the total amount of nutritive protein administered is selected from 0.1 g to 1 g, 1 g to 5 g, from 2 g to 10 g, from 5 g to 15 g, from 10 g to 20 g, from 15 g to 25 g, from 20 g to 40 g, from 25-50 g, and from 30-60 g. In some embodiments the dosage form is designed for administration of at least one nutritive protein disclosed herein, wherein the total amount of nutritive protein administered is selected from about 0.1 g, 0.1 g-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the dosage form is designed for administration of at least one nutritive protein disclosed herein, wherein the total amount of essential amino acids administered is selected from 0.1 g to 1 g, from 1 g to 5 g, from 2 g to 10 g, from 5 g to 15 g, from 10 g to 20 g, and from 1-30 g. In some embodiments the dosage form is designed for administration of at least one nutritive protein disclosed herein, wherein the total amount of nutritive protein administered is selected from about 0.1 g, 0.1-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the nutritive protein or nutritive composition is consumed at a rate of from 0.1 g to 1 g a day, 1 g to 5 g a day, from 2 g to 10 g a day, from 5 g to 15 g a day, from 10 g to 20 g a day, from 15 g to 30 g a day, from 20 g to 40 g a day, from 25 g to 50 g a day, from 40 g to 80 g a day, from 50 g to 100 g a day, or more.

In some embodiments, of the total protein intake by the subject, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or about 100% of the total protein intake by the subject over a dietary period is made up of at least one nutritive protein according to this disclosure. In some embodiments, of the total protein intake by the subject, from 5% to 100% of the total protein intake by the subject, from 5% to 90% of the total protein intake by the subject, from 5% to 80% of the total protein intake by the subject, from 5% to 70% of the total protein intake by the subject, from 5% to 60% of the total protein intake by the subject, from 5% to 50% of the total protein intake by the subject, from 5% to 40% of the total protein intake by the subject, from 5% to 30% of the total protein intake by the subject, from 5% to 20% of the total protein intake by the subject, from 5% to 10% of the total protein intake by the subject, from 10% to 100% of the total protein intake by the subject, from 10% to 100% of the total protein intake by the subject, from 20% to 100% of the total protein intake by the subject, from 30% to 100% of the total protein intake by the subject, from 40% to 100% of the total protein intake by the subject, from 50% to 100% of the total protein intake by the subject, from 60% to 100% of the total protein intake by the subject, from 70% to 100% of the total protein intake by the subject, from 80% to 100% of the total protein intake by the subject, or from 90% to 100% of the total protein intake by the subject, over a dietary period, is made up of at least one nutritive protein according to this disclosure. In some embodiments the at least one nutritive protein of this disclosure accounts for at least 5%, at least 10%, at least 15%, at least 20%, at least 25%, at least 30%, at least 35%, at least 40%, at least 45%, or at least 50% of the subject's calorie intake over a dietary period.

In some embodiments the at least one nutritive protein according to this disclosure comprises at least 2 nutritive proteins of this disclosure, at least 3 nutritive proteins of this disclosure, at least 4 nutritive proteins of this disclosure, at least 5 nutritive proteins of this disclosure, at least 6 nutritive proteins of this disclosure, at least 7 nutritive proteins of this disclosure, at least 8 nutritive proteins of this disclosure, at least 9 nutritive proteins of this disclosure, at least 10 nutritive proteins of this disclosure, or more.

In some embodiments the dietary period is 1 meal, 2 meals, 3 meals, at least 1 day, at least 2 days, at least 3 days, at least 4 days, at least 5 days, at least 6 days, at least 1 week, at least 2 weeks, at least 3 weeks, at least 4 weeks, at least 1 month, at least 2 months, at least 3 months, at least 4 months, at least 5 months, at least 6 months, or at least 1 year. In some embodiments the dietary period is from 1 day to 1 week, from 1 week to 4 weeks, from 1 month to 3 months, from 3 months to 6 months, or from 6 months to 1 year.

Clinical studies provide evidence that protein prevents muscle loss due to aging or bed rest. In particular, studies have shown that protein supplementation increases muscle fractional synthetic rate (FSR) during prolonged bed rest, maintains leg mass and strength during prolonged bed rest, increases lean body mass, improves functional measures of gait and balance, and may serve as a viable intervention for individuals at risk of sarcopenia due to immobility or prolonged bed rest. (See, e.g., Paddon-Jones D, et al. J Clin Endocrinol Metab 2004, 89:4351-4358; Ferrando, A et al. Clinical Nutrition 2009 1-6; Katsanos C et al. Am J Physiol Endocrinol Metab. 2006, 291: 381-387).

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, the amino acid leucine is an important factor in stimulating muscle protein synthesis. (See, e.g., Borscheim E et al. Am J Physiol Endocrinol Metab 2002, 283: E648-E657; Borsheim E et al. Clin Nutr. 2008, 27: 189-95; Esmarck B et al J Physiol 2001, 535: 301-311; Moore D et al. Am J Clin Nutr 2009, 89: 161-8).

In another aspect this disclosure provides methods of maintaining or increasing at least one of muscle mass, muscle strength, and functional performance in a subject. In some embodiments the methods comprise providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the sufficient amount of a nutritive protein of this disclosure, a nutritive composition of this disclosure, or a nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of maintaining or achieving a desirable body mass index in a subject. In some embodiments the methods comprise providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the sufficient amount of a nutritive protein of this disclosure, a nutritive composition of this disclosure, or a nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of providing protein to a subject with protein-energy malnutrition. In some embodiments the methods comprise providing to the subject a sufficient amount of a nutritive protein of this disclosure, a nutritive composition of this disclosure, or a nutritive composition made by a method of this disclosure. In some embodiments the nutritive protein of this disclosure, nutritive composition of this disclosure, or nutritive composition made by a method of this disclosure is consumed by the subject by an oral, enteral, or parenteral route.

The need for essential amino acid supplementation has been suggested in cancer patients and other patients suffering from cachexia. Dietary studies in mice have shown survival and functional benefits to cachectic cancer-bearing mice through dietary intervention with essential amino acids. Beyond cancer, essential amino acid supplementation has also shown benefits, such as improved muscle function and muscle gain, in patients suffering from other diseases who have difficulty exercising and therefore suffer from muscular deterioration, such as chronic obstructive pulmonary disease, chronic heart failure, HIV, and other disease states.

Studies have shown that specific amino acids have advantages in managing cachexia. A relatively high content of BCAAs and Leu in diets are thought to have a positive effect in cachexia by promoting total protein synthesis by signaling an increase in translation, enhancing insulin release, and inhibiting protein degradation. Thus, consuming increased dietary BCAAs in general and/or Leu in particular will contribute positively to reduce or reverse the effects of cachexia. Because nitrogen balance is important in countering the underlying cause of cachexia it is thought that consuming increased dietary glutamine and/or arginine will contribute positively to reduce or reverse the effects of cachexia. (See, e.g., Op den Kamp C, Langen R, Haegens A, Schols A. "Muscle atrophy in cachexia: can dietary protein tip the balance?" Current Opinion in Clinical Nutrition and Metabolic Care 2009, 12:611-616; Poon R T-P, Yu W-C, Fan S-T, et al. "Long-term oral branched chain amino acids in patients undergoing chemoembolization for hepatocellular carcinoma:a randomized trial." Aliment Pharmacol Ther 2004; 19:779-788; Tayek J A, Bistrian B R, Hehir D J, Martin R, Moldawer L L, Blackburn G L. "Improved protein kinetics and albumin synthesis by branched chain amino acid-enriched total parenteral nutrition in cancer cachexia." Cancer. 1986; 58:147-57; Xi P, Jiang Z, Zheng C, Lin Y, Wu G "Regulation of protein metabolism by glutamine: implications for nutrition and health." Front Biosci. 2011 Jan. 1; 16:578-97).

Accordingly, also provided herein are methods of treating cachexia in a subject. In some embodiments a sufficient amount of a nutritive protein of this disclosure, a nutritive composition of this disclosure, or a nutritive composition made by a method of this disclosure for a subject with cachexia is an amount such that the amount of protein of this disclosure ingested by the person meets or exceeds the metabolic needs (which are often elevated). A protein intake of 1.5 g/kg of body weight per day or 15-20% of total caloric intake appears to be an appropriate target for persons with cachexia. In some embodiments all of the protein consumed by the subject is a nutritive protein according to this disclosure. In some embodiments nutritive protein according to this disclosure is combined with other sources of protein and/or free amino acids to provide the total protein intake of the subject. In some embodiments the subject is at least one of elderly, critically-medically ill, and suffering from protein-energy malnutrition. In some embodiments the subject suffers from a disease that makes exercise difficult and therefore causes muscular deterioration, such as chronic obstructive pulmonary disease, chronic heart failure, HIV, cancer, and other disease states. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to this disclosure, the nutritive composition according to disclosure, or the nutritive composition made by a method according to disclosure is consumed by the subject by an oral, enteral, or parenteral route.

Sarcopenia is the degenerative loss of skeletal muscle mass (typically 0.5-1% loss per year after the age of 25), quality, and strength associated with aging. Sarcopenia is a component of the frailty syndrome. The European Working Group on Sarcopenia in Older People (EWGSOP) has developed a practical clinical definition and consensus diagnostic criteria for age-related sarcopenia. For the diagnosis of sarcopenia, the working group has proposed using the presence of both low muscle mass and low muscle function (strength or performance). Sarcopenia is characterized first by a muscle atrophy (a decrease in the size of the muscle), along with a reduction in muscle tissue "quality," caused by such factors as replacement of muscle fibres with fat, an increase in fibrosis, changes in muscle metabolism, oxidative stress, and degeneration of the neuromuscular junction. Combined, these changes lead to progressive loss of muscle function and eventually to frailty. Frailty is a common geriatric syndrome that embodies an elevated risk of catastrophic declines in health and function among older adults. Contributors to frailty can include sarcopenia, osteoporosis, and muscle weakness. Muscle weakness, also known as muscle fatigue, (or "lack of strength") refers to the inability to exert force with one's skeletal muscles. Weakness often follows muscle atrophy and a decrease in activity, such as after a long bout of bedrest as a result of an illness. There is also a gradual onset of muscle weakness as a result of sarcopenia.

The nutritive proteins of this disclosure are useful for treating sarcopenia or frailty once it develops in a subject or for preventing the onset of sarcopenia or frailty in a subject who is a member of an at risk groups. In some embodiments all of the protein consumed by the subject is a nutritive protein according to this disclosure. In some embodiments nutritive protein according to this disclosure is combined with other sources of protein and/or free amino acids to provide the total protein intake of the subject. In some embodiments the subject is at least one of elderly, critically-medically ill, and suffering from protein-energy malnutrition. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to this disclosure, the nutritive composition according to disclosure, or the nutritive composition made by a method according to disclosure is consumed by the subject by an oral, enteral, or parenteral route.

Obesity is a multifactorial disorder associated with a host of comorbidities including hypertension, type 2 diabetes, dyslipidemia, coronary heart disease, stroke, cancer (e.g., endometrial, breast, and colon), osteoarthritis, sleep apnea, and respiratory problems. The incidence of obesity, defined as a body mass index >30 kg/m2, has increased dramatically in the United States, from 15% (1976-1980) to 33% (2003-2004), and it continues to grow. Although the mechanisms contributing to obesity are complex and involve the interplay of behavioral components with hormonal, genetic, and metabolic processes, obesity is largely viewed as a lifestyle-dependent condition with 2 primary causes: excessive energy intake and insufficient physical activity. With respect to energy intake, there is evidence that modestly increasing the proportion of protein in the diet, while controlling total energy intake, may improve body composition, facilitate fat loss, and improve body weight maintenance after weight loss. Positive outcomes associated with increased dietary protein are thought to be due primarily to lower energy intake associated with increased satiety, reduced energy efficiency and/or increased thermogenesis, positive effects on body composition (specifically lean muscle mass), and enhanced glycemic control.

Dietary proteins are more effective in increasing postprandial energy expenditure than isocaloric intakes of carbohydrates or fat (see, e.g., Dauncey M, Bingham S. "Dependence of 24 h energy expenditure in man on composition of the nutrient intake." Br J Nutr 1983, 50: 1-13; Karst H et al. "Diet-induced thermogenesis in man: thermic effects of single proteins, carbohydrates and fats depending on their energy amount." Ann Nutr Metab. 1984, 28: 245-52; Tappy L et al "Thermic effect of infused amino acids in healthy humans and in subjects with insulin resistance." Am J Clin Nutr 1993, 57 (6): 912-6). This property along with other properties (satiety induction; preservation of lean body mass) make protein an attractive component of diets directed at weight management. The increase in energy expenditure caused by such diets may in part be due to the fact that the energy cost of digesting and metabolizing protein is higher than for other calorie sources. Protein turnover, including protein synthesis, is an energy consuming process. In addition, high protein diets may also up-regulate uncoupling protein in liver and brown adipose, which is positively correlated with increases in energy expenditure. It has been theorized that different proteins may have unique effects on energy expenditure.

Studies suggest that ingestion of protein, particularly proteins with high EAA and/or BCAA content, leads to distinct effects on thermogenesis and energy expenditure (see, e.g., Mikkelsen P. et al. "Effect of fat-reduced diets on 24 h energy expenditure: comparisons between animal protein, vegetable protein and carbohydrate." Am J Clin Nutr 2000, 72:1135-41; Acheson K. et al. "Protein choices targeting thermogenesis and metabolism." Am J Clin Nutr 2011, 93:525-34; Alfenas R. et al. "Effects of protein quality on appetite and energy metabolism in normal weight subjects" Arg Bras Endocrinol Metabol 2010, 54 (1): 45-51; Lorenzen J. et al. "The effect of milk proteins on appetite regulation and diet-induced thermogenesis." J Clin Nutr 2012 66 (5): 622-7). Additionally, L-tyrosine has been identified as an amino acid that plays a role in thermogenesis (see, e.g., Belza A. et al. "The beta-adrenergic antagonist propranolol partly abolishes thermogenic response to bioactive food ingredients." Metabolism 2009, 58 (8): 1137-44). Further studies suggest that Leucine and Arginine supplementation appear to alter energy metabolism by directing substrate to lean body mass rather than adipose tissue (Dulloo A. "The search for compounds that stimulate thermogenesis in obesity management: from pharmaceuticals to functional food ingredients." Obes Rev 2011 12: 866-83).

Collectively the literature suggests that different protein types leads to distinct effects on thermogenesis. Because proteins or peptides rich in EAAs, BCAA, and/or at least one of Tyr, Arg, and Leu are believed to have a stimulatory effect on thermogenesis, and because stimulation of thermogenesis is believed to lead to positive effects on weight management, this disclosure also provides products and methods useful to stimulation thermogenesis and/or to bring about positive effects on weight management in general.

More particularly, this disclosure provides methods of increasing thermogenesis in a subject. In some embodiments the methods comprise providing to the subject a sufficient amount of a nutritive protein of this disclosure, a nutritive composition of this disclosure, or a nutritive composition made by a method of this disclosure. In some embodiments the subject is obese. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to disclosure, the nutritive composition according to disclosure, or the nutritive composition made by a method according to disclosure is consumed by the subject by an oral, enteral, or parenteral route.

At the basic level, the reason for the development of an overweight condition is due to an imbalance between energy intake and energy expenditure. Attempts to reduce food at any particular occasion (satiation) and across eating occasions (satiety) have been a major focus of recent research. Reduced caloric intake as a consequence of feeling satisfied during a meal and feeling full after a meal results from a complex interaction of internal and external signals. Various nutritional studies have demonstrated that variation in food properties such as energy density, content, texture and taste influence both satiation and satiety.

There are three macronutrients that deliver energy: fat, carbohydrates and proteins. A gram of protein or carbohydrate provides 4 calories while a gram of fat 9 calories. Protein generally increases satiety to a greater extent than carbohydrates or fat and therefore may facilitate a reduction in calorie intake. However, there is considerable evidence that indicates the type of protein matters in inducing satiety (see, e.g., W. L. Hall, et al. "Casein and whey exert different effects on plasma amino acid profiles, gastrointestinal hormone secretion and appetite." Br J Nutr. 2003 February, 89(2):239-48; R. Abou-Samra, et al. "Effect of different protein sources on satiation and short-term satiety when consumed as a starter." Nutr J. 2011 Dec. 23, 10:139; T. Akhavan, et al. "Effect of premeal consumption of whey protein and its hydrolysate on food intake and postmeal glycemia and insulin responses in young adults." Am J Clin Nutr. 2010 April, 91(4):966-75, Epub 2010 Feb. 17; MA Veldhorst "Dose-dependent satiating effect of whey relative to casein or soy" Physiol Behav. 2009 Mar. 23, 96(4-5):675-82). Evidence indicates that protein rich in Leucine is particularly effective at inducing satiety (see, e.g., Fromentin G et al "Peripheral and central mechanisms involved in the control of food intake by dietary amino acids and proteins." Nutr Res Rev 2012 25: 29-39).

In some embodiments a nutritive protein of this disclosure is consumed by a subject concurrently with at least one pharmaceutical or biologic drug product. In some embodiments the beneficial effects of the nutritive protein and the at least one pharmaceutical or biologic drug product have an additive effect while in some embodiments the beneficial effects of the nutritive protein and the at least one pharmaceutical or biologic drug product have a synergistic effect. Examples of pharmaceutical or biologic drug products that can be administered with the nutritive proteins of this disclosure are well known in the art. For example, when a nutritive protein of this disclosure is used to maintain or increase at least one of muscle mass, muscle strength, and functional performance in a subject, the nutritive protein may be consumed by a subject concurrently with a therapeutic dosage regime of at least one pharmaceutical or biologic drug product indicated to maintain or increase at least one of muscle mass, muscle strength, and functional performance in a subject, such as an anabolic steroid. When a nutritive protein of this disclosure is used to maintain or achieve a desirable body mass index in a subject, the nutritive protein may be consumed by a subject concurrently with a therapeutic dosage regime of at least one pharmaceutical or biologic drug product indicated to maintain or achieve a desirable body mass index in a subject, such as orlistat, lorcaserin, sibutramine, rimonabant, metformin, exenatide, or pramlintide. When a nutritive protein of this disclosure is used to induce at least one of a satiation response and a satiety response in a subject, the nutritive protein may be consumed by a subject concurrently with a therapeutic dosage regime of at least one pharmaceutical or biologic drug product indicated to induce at least one of a satiation response and a satiety response in a subject, such as rimonabant, exenatide, or pramlintide. When a nutritive protein of this disclosure is used to treat at least one of cachexia, sarcopenia and frailty in a subject, the nutritive protein may be consumed by a subject concurrently with a therapeutic dosage regime of at least one pharmaceutical or biologic drug product indicated to treat at least one of cachexia, sarcopenia and frailty, such as omega-3 fatty acids or anabolic steroids. Because of the role of dietary protein in inducing satiation and satiety, the nutritive proteins and nutritive compositions disclosed herein can be used to induce at least one of a satiation response and a satiety response in a subject. In some embodiments the methods comprise providing to the subject a sufficient amount of a nutritive protein of this disclosure, a nutritive composition of this disclosure, or a nutritive composition made by a method of this disclosure. In some embodiments the subject is obese. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to disclosure, the nutritive composition according to disclosure, or the nutritive composition made by a method according to disclosure is consumed by the subject by an oral, enteral, or parenteral route.

In some embodiments incorporating a least one nutritive protein or nutritive composition of this disclosure into the diet of a subject has at least one effect selected from inducing postprandial satiety (including by suppressing hunger), inducing thermogenesis, reducing glycemic response, positively affecting energy expenditure positively affecting lean body mass, reducing the weight gain caused by overeating, and decreasing energy intake. In some embodiments incorporating a least one nutritive protein or nutritive composition of this disclosure into the diet of a subject has at least one effect selected from increasing loss of body fat, reducing lean tissue loss, improving lipid profile, and improving glucose tolerance and insulin sensitivity in the subject.

EXAMPLES

The following examples serve to more fully describe the manner of using the invention. These examples are presented for illustrative purposes and should not serve to limit the true scope of the invention.

Example 1

Identification of Protein Fragments Containing Ratios of Essential Amino Acids, Branch Chain Amino Acids, and Leucine Greater than or Equal to Whey and Containing all Essential Amino Acids The UniProtKB/Swiss-Prot (a collaboration between the European Bioinformatics Institute and the Swiss Institute of Bioinformatics) is a manually curated and reviewed protein database, and was used as the starting point for protein identification. Proteins from the edible species *Solanum lycopersicum, Zea mays, Oryza sativa* subsp. *Japonica, Glycine max, Ovis aries, Pisum sativum, Spinacia oleracea, Oryza sativa* subsp. *Indica, Triticum aestivum, Sus scrofa, Prunus persica, Capsicum annuum, Malus domestica, Thunnus albacares, Capra hircus, Cicer arietinum, Salmo salar, Meleagris gallopavo, Solanum tuberosum,* and *Agaricus bisporus* having greater than or equal to fifty (50) amino acids were considered as viable targets. Roughly 8,415 such proteins were selected for evaluation and the proteins were then fragmented into roughly fifty (50), roughly one hundred (100), or roughly one hundred and fifty (150) amino acids portions of the original protein, designed to contain digestive enzyme cleavage sites on both ends. In addition, the proteins were screened against a database of known allergens to determine whether any had greater than 50% global homology to a known allergen. A total of 1,000 fragments were identified that contain greater than or equal to 51% EAA, greater than or equal to 25% BCAA, and greater than or equal to 13% Leu, and contain all essential amino acids, and have less than 50% global homology to known allergens (SEQ ID NOS: 1 to 1000). (Note that for Examples 1-5, 51% EAA/25% BCAA/13% Leu represent values that are each 1-2% greater than those of whey (defined herein to be 49% EAA/24% BCAA/11% Leu). These values were used to identify nutritive protein fragments of interest for the purposes of this Example only, in order to ensure that the identified proteins have a higher content of EAA, BCAA, and Leu than whey). For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), antinutricity (i.e., percent homology to known protease inhibitors, as described herein), and human homology (i.e., percent homology to known human proteins, as described herein) were calculated, and the total number of Cys residues ("C") were determined. The characteristics of 75 representative fragments thus identified are presented in Tables 3A and 3B.

TABLE 3A

| Seq ID No | UniProt | FragEnds | EAA | BCAA | L | C |
|---|---|---|---|---|---|---|
| 1 | Q29550 | 101:301 | 0.53 | 0.27 | 0.13 | 3 |
| 2 | Q29078 | 1:176 | 0.52 | 0.27 | 0.14 | 5 |
| 3 | Q29550 | 201:426 | 0.56 | 0.25 | 0.13 | 2 |
| 4 | Q29078 | 1:76 | 0.60 | 0.34 | 0.20 | 3 |
| 5 | Q9N2D1 | 1:76 | 0.57 | 0.27 | 0.18 | 3 |
| 6 | Q29079 | 1:76 | 0.56 | 0.29 | 0.18 | 1 |
| 7 | Q29550 | 101:176 | 0.53 | 0.31 | 0.15 | 1 |
| 8 | Q70BM6 | 201:326 | 0.58 | 0.26 | 0.15 | 0 |
| 9 | Q70BM6 | 201:426 | 0.59 | 0.30 | 0.17 | 3 |
| 10 | Q70BM6 | 101:326 | 0.56 | 0.28 | 0.14 | 2 |
| 11 | O81122 | 101:301 | 0.53 | 0.29 | 0.16 | 1 |
| 12 | Q9M7M1 | 101:201 | 0.55 | 0.28 | 0.19 | 1 |
| 13 | O81122 | 101:201 | 0.55 | 0.28 | 0.19 | 1 |
| 14 | Q9M7M1 | 101:301 | 0.53 | 0.28 | 0.16 | 1 |
| 15 | Q8WNV7 | 151:226 | 0.51 | 0.29 | 0.14 | 1 |
| 16 | P50118 | 176:276 | 0.52 | 0.26 | 0.15 | 3 |
| 17 | P12263 | 451:526 | 0.55 | 0.26 | 0.13 | 0 |
| 18 | Q29197 | 26:126 | 0.52 | 0.29 | 0.18 | 0 |
| 19 | O02799 | 151:301 | 0.54 | 0.26 | 0.19 | 2 |
| 20 | P80229 | 201:276 | 0.55 | 0.27 | 0.18 | 1 |
| 21 | Q29624 | 226:326 | 0.59 | 0.25 | 0.13 | 2 |
| 22 | A5GFQ5 | 26:151 | 0.52 | 0.25 | 0.15 | 3 |
| 23 | Q5GN48 | 1601:1676 | 0.57 | 0.26 | 0.15 | 0 |
| 24 | Q5GN48 | 1026:1101 | 0.55 | 0.26 | 0.16 | 2 |
| 25 | A6M931 | 176:276 | 0.54 | 0.26 | 0.13 | 1 |
| 26 | P49039 | 1:101 | 0.51 | 0.27 | 0.14 | 0 |
| 27 | P79430 | 226:326 | 0.62 | 0.25 | 0.14 | 3 |
| 28 | P61291 | 1:151 | 0.53 | 0.27 | 0.14 | 2 |
| 29 | B5X2B8 | 126:326 | 0.52 | 0.25 | 0.13 | 3 |
| 30 | Q1A730 | 226:301 | 0.52 | 0.28 | 0.20 | 2 |
| 31 | D2SW95 | 276:476 | 0.52 | 0.31 | 0.13 | 3 |
| 32 | O02799 | 251:326 | 0.57 | 0.29 | 0.22 | 1 |
| 33 | B5RI54 | 126:251 | 0.54 | 0.26 | 0.13 | 2 |
| 34 | P21999 | 76:176 | 0.51 | 0.28 | 0.13 | 5 |
| 35 | Q07511 | 151:276 | 0.52 | 0.27 | 0.13 | 2 |
| 36 | A5A779 | 351:476 | 0.53 | 0.31 | 0.24 | 4 |
| 37 | Q6ITT4 | 476:601 | 0.54 | 0.30 | 0.16 | 1 |
| 38 | O46374 | 876:1076 | 0.55 | 0.26 | 0.13 | 2 |
| 39 | Q4U116 | 901:1076 | 0.55 | 0.25 | 0.14 | 2 |
| 40 | P04045 | 376:476 | 0.53 | 0.27 | 0.13 | 1 |
| 41 | Q29121 | 151:226 | 0.52 | 0.30 | 0.13 | 2 |
| 42 | Q2VEC3 | 1601:1726 | 0.54 | 0.27 | 0.16 | 1 |

TABLE 3A-continued

| Seq ID No | UniProt | FragEnds | EAA | BCAA | L | C |
|---|---|---|---|---|---|---|
| 43 | B5X737 | 26:176 | 0.57 | 0.26 | 0.13 | 2 |
| 44 | Q9XSW2 | 201:401 | 0.53 | 0.25 | 0.15 | 8 |
| 45 | P19756 | 276:351 | 0.60 | 0.32 | 0.14 | 0 |
| 46 | P67931 | 101:201 | 0.51 | 0.26 | 0.19 | 1 |
| 47 | Q9AWA5 | 401:476 | 0.58 | 0.27 | 0.13 | 0 |
| 48 | O46374 | 976:1051 | 0.56 | 0.26 | 0.19 | 2 |
| 49 | Q9XSW2 | 301:401 | 0.59 | 0.29 | 0.16 | 3 |
| 50 | Q8MIQ9 | 551:651 | 0.56 | 0.28 | 0.15 | 1 |
| 51 | O02668 | 526:626 | 0.53 | 0.26 | 0.14 | 0 |
| 52 | Q6UAQ8 | 51:226 | 0.51 | 0.27 | 0.13 | 3 |
| 53 | P21343 | 326:401 | 0.54 | 0.33 | 0.17 | 1 |
| 54 | P79430 | 126:326 | 0.58 | 0.26 | 0.13 | 5 |
| 55 | P10691 | 26:176 | 0.52 | 0.25 | 0.14 | 0 |
| 56 | O02697 | 626:701 | 0.52 | 0.27 | 0.19 | 1 |
| 57 | Q5VI41 | 676:751 | 0.53 | 0.30 | 0.13 | 1 |
| 58 | O97716 | 201:376 | 0.52 | 0.25 | 0.13 | 4 |
| 59 | Q66UW5 | 51:151 | 0.52 | 0.25 | 0.16 | 2 |
| 60 | D2SW95 | 1:201 | 0.54 | 0.27 | 0.14 | 5 |
| 61 | O46491 | 201:351 | 0.53 | 0.25 | 0.15 | 1 |
| 62 | Q52QT8 | 1:151 | 0.53 | 0.26 | 0.16 | 5 |
| 63 | Q9P4T7 | 1:76 | 0.53 | 0.25 | 0.17 | 0 |
| 64 | Q2VEE8 | 201:276 | 0.60 | 0.25 | 0.14 | 0 |
| 65 | P37831 | 251:376 | 0.52 | 0.26 | 0.16 | 0 |
| 66 | B9EPI1 | 1:126 | 0.56 | 0.30 | 0.16 | 4 |
| 67 | B5X2B8 | 126:201 | 0.61 | 0.30 | 0.15 | 0 |
| 68 | O02799 | 526:651 | 0.57 | 0.26 | 0.16 | 1 |
| 69 | Q99028 | 76:151 | 0.53 | 0.30 | 0.16 | 3 |
| 70 | Q07511 | 51:276 | 0.51 | 0.26 | 0.13 | 4 |
| 71 | P08454 | 1:76 | 0.57 | 0.28 | 0.13 | 1 |
| 72 | Q5GN48 | 2251:2501 | 0.51 | 0.26 | 0.14 | 0 |
| 73 | O64390 | 276:426 | 0.52 | 0.25 | 0.15 | 1 |
| 74 | P09954 | 1:101 | 0.53 | 0.31 | 0.14 | 0 |
| 75 | P29196 | 801:876 | 0.57 | 0.28 | 0.18 | 0 |

TABLE 3B

| Seq ID No | Solv Score | Agg Score | Allergenicity | Toxicity | Antinutricity | Human Homology |
|---|---|---|---|---|---|---|
| 1 | −16.14 | 0.70 | 0.58 | 0.40 | 0.23 | 0.83 |
| 2 | −15.72 | 0.57 | 0.54 | 0.00 | 0.25 | 0.50 |
| 3 | −18.83 | 0.61 | 0.45 | 0.30 | 0.00 | 0.76 |
| 4 | −18.32 | 0.80 | 0.43 | 0.28 | 0.29 | 0.46 |
| 5 | −10.78 | 0.78 | 0.42 | 0.42 | 0.29 | 0.78 |
| 6 | −18.03 | 0.62 | 0.41 | 0.28 | 0.28 | 0.48 |
| 7 | −14.86 | 0.78 | 0.40 | 0.43 | 0.26 | 0.79 |
| 8 | −17.96 | 0.60 | 0.36 | 0.00 | 0.25 | 0.81 |
| 9 | −13.70 | 0.90 | 0.36 | 0.00 | 0.21 | 0.82 |
| 10 | −15.03 | 0.80 | 0.36 | 0.00 | 0.22 | 0.81 |
| 11 | −18.93 | 0.53 | 0.36 | 0.00 | 0.21 | 0.00 |
| 12 | −22.36 | 0.47 | 0.35 | 0.21 | 0.00 | 0.00 |
| 13 | −22.36 | 0.47 | 0.35 | 0.21 | 0.00 | 0.00 |
| 14 | −18.90 | 0.52 | 0.35 | 0.00 | 0.24 | 0.00 |
| 15 | −12.53 | 0.69 | 0.35 | 0.00 | 0.00 | 0.82 |
| 16 | −20.41 | 0.43 | 0.35 | 0.00 | 0.25 | 0.86 |
| 17 | −18.65 | 0.43 | 0.25 | 0.43 | 0.24 | 0.83 |
| 18 | −28.11 | 0.37 | 0.31 | 0.00 | 0.00 | 0.98 |
| 19 | −26.99 | 0.37 | 0.33 | 0.24 | 0.22 | 0.81 |
| 20 | −26.56 | 0.35 | 0.34 | 0.29 | 1.00 | 0.79 |
| 21 | −26.33 | 0.75 | 0.30 | 0.29 | 0.22 | 0.84 |
| 22 | −25.32 | 0.42 | 0.29 | 0.23 | 0.29 | 0.95 |
| 23 | −25.11 | 0.34 | 0.29 | 0.00 | 0.00 | 0.93 |
| 24 | −24.91 | 0.25 | 0.28 | 0.00 | 0.26 | 0.88 |
| 25 | −24.78 | 0.47 | 0.31 | 0.00 | 0.20 | 1.00 |
| 26 | −24.60 | 0.44 | 0.29 | 0.25 | 0.31 | 0.25 |
| 27 | −24.55 | 0.79 | 0.28 | 0.24 | 0.27 | 0.77 |
| 28 | −24.41 | 0.38 | 0.33 | 0.00 | 0.25 | 1.00 |
| 29 | −24.09 | 0.41 | 0.31 | 0.00 | 0.25 | 0.50 |
| 30 | −23.74 | 0.38 | 0.27 | 0.26 | 0.26 | 0.99 |
| 31 | −23.68 | 0.62 | 0.31 | 0.00 | 0.23 | 1.00 |
| 32 | −23.68 | 0.38 | 0.27 | 0.00 | 0.24 | 0.80 |
| 33 | −23.57 | 0.39 | 0.32 | 0.00 | 0.00 | 0.89 |
| 34 | −23.51 | 0.64 | 0.33 | 0.17 | 0.27 | 0.99 |
| 35 | −23.41 | 0.45 | 0.34 | 0.21 | 0.00 | 0.29 |
| 36 | −23.38 | 0.50 | 0.32 | 0.23 | 0.26 | 0.98 |
| 37 | −23.11 | 0.63 | 0.30 | 0.22 | 0.24 | 1.00 |
| 38 | −23.11 | 0.41 | 0.33 | 0.22 | 0.00 | 0.99 |
| 39 | −23.02 | 0.72 | 0.29 | 0.00 | 0.23 | 0.99 |
| 40 | −22.98 | 0.36 | 0.30 | 0.00 | 0.28 | 0.57 |
| 41 | −22.88 | 0.59 | 0.30 | 0.27 | 0.29 | 1.00 |
| 42 | −22.87 | 0.49 | 0.32 | 0.00 | 0.23 | 0.00 |
| 43 | −22.79 | 0.42 | 0.31 | 0.21 | 0.23 | 0.59 |
| 44 | −22.74 | 0.56 | 0.31 | 0.00 | 0.21 | 0.88 |
| 45 | −22.73 | 0.80 | 0.26 | 0.00 | 0.30 | 0.91 |
| 46 | −22.72 | 0.50 | 0.29 | 0.00 | 0.30 | 0.73 |
| 47 | −22.62 | 0.38 | 0.23 | 0.23 | 0.00 | 0.24 |
| 48 | −22.55 | 0.42 | 0.24 | 0.27 | 0.24 | 1.00 |
| 49 | −22.53 | 0.71 | 0.31 | 0.00 | 0.26 | 0.96 |
| 50 | −22.43 | 0.59 | 0.30 | 0.00 | 0.00 | 0.90 |
| 51 | −22.38 | 0.48 | 0.30 | 0.00 | 1.00 | 0.76 |
| 52 | −22.32 | 0.47 | 0.33 | 0.00 | 0.00 | 0.96 |
| 53 | −22.21 | 0.49 | 0.26 | 0.00 | 0.26 | 0.30 |
| 54 | −22.18 | 0.64 | 0.31 | 0.20 | 0.21 | 0.78 |
| 55 | −22.18 | 0.45 | 0.32 | 0.20 | 0.24 | 0.00 |
| 56 | −22.16 | 0.52 | 0.24 | 0.00 | 0.23 | 1.00 |
| 57 | −22.06 | 0.82 | 0.27 | 0.24 | 0.27 | 0.79 |
| 58 | −22.05 | 0.59 | 0.30 | 0.00 | 0.22 | 1.00 |
| 59 | −22.01 | 0.36 | 0.29 | 0.00 | 0.00 | 0.96 |
| 60 | −21.91 | 0.62 | 0.33 | 0.00 | 0.21 | 1.00 |
| 61 | −21.88 | 0.46 | 0.33 | 0.21 | 0.18 | 0.73 |
| 62 | −21.83 | 0.49 | 0.30 | 0.24 | 0.22 | 0.99 |
| 63 | −21.80 | 0.39 | 0.29 | 0.00 | 0.30 | 0.51 |
| 64 | −21.75 | 0.44 | 0.28 | 0.00 | 0.24 | 0.22 |
| 65 | −21.74 | 0.58 | 0.31 | 0.00 | 0.26 | 0.00 |
| 66 | −21.65 | 0.52 | 0.33 | 0.25 | 0.26 | 0.82 |
| 67 | −21.59 | 0.58 | 0.24 | 0.00 | 0.27 | 0.71 |
| 68 | −21.58 | 0.40 | 0.30 | 0.26 | 0.25 | 0.85 |
| 69 | −21.57 | 0.64 | 0.25 | 0.22 | 0.28 | 0.96 |
| 70 | −21.54 | 0.46 | 0.31 | 0.22 | 0.00 | 0.28 |
| 71 | −21.50 | 0.73 | 0.25 | 0.28 | 1.00 | 0.28 |
| 72 | −21.47 | 0.34 | 0.32 | 0.22 | 0.00 | 0.86 |
| 73 | −21.43 | 0.46 | 0.29 | 0.22 | 0.25 | 0.38 |
| 74 | −21.41 | 0.62 | 0.31 | 0.00 | 0.27 | 0.85 |
| 75 | −21.41 | 0.58 | 0.28 | 0.00 | 0.00 | 0.29 |

Example 2

Identification of Protein Fragments Containing Ratios of Essential Amino Acids, Branch Chain Amino Acids, and Leucine Greater than or Equal to Whey Fragments from the set of 8,415 proteins described in Example 1 were evaluated for amino acid content, percentage of essential amino acids ("EAA"), the percentage of branched chain amino acids ("BCAA"), the percentage of leucine ("L"), and whether the protein contained all of the essential amino acids were calculated for each protein. In addition, the protein fragments were screened against a database of known allergens to determine whether any had greater than 50% global homology to a known allergen. A total of 414 protein fragments were identified that contain greater than or equal to 51% EAA, greater than or equal to 25% BCAA, and greater than or equal to 13% Leu, and have less than 50% global homology to known allergens (SEQ ID NOS: 1001 to 1414). For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), antinutricity (i.e., percent homology to known protease inhibitors, as described herein), and human homology (i.e., percent homology to known human proteins, as described herein) were calculated, and the total number of Cys residues ("C") were determined. The characteristics of 75 representative proteins thus identified are presented in Tables 4A and 4B.

TABLE 4A

| Seq ID No | UniProt | FragEnds | EAA | BCAA | L | C |
|---|---|---|---|---|---|---|
| 1001 | P21641 | 1:126 | 0.52 | 0.30 | 0.19 | 1 |
| 1002 | Q41782 | 151:276 | 0.52 | 0.25 | 0.14 | 4 |
| 1003 | O24174 | 176:251 | 0.53 | 0.29 | 0.15 | 3 |
| 1004 | Q41784 | 201:276 | 0.55 | 0.26 | 0.17 | 3 |
| 1005 | P09315 | 276:351 | 0.51 | 0.35 | 0.14 | 1 |
| 1006 | Q43695 | 201:276 | 0.53 | 0.26 | 0.17 | 3 |
| 1007 | P18025 | 201:276 | 0.54 | 0.26 | 0.17 | 3 |
| 1008 | P18026 | 201:276 | 0.54 | 0.26 | 0.17 | 3 |
| 1009 | Q43697 | 201:276 | 0.54 | 0.26 | 0.17 | 3 |
| 1010 | Q41783 | 201:276 | 0.54 | 0.26 | 0.17 | 3 |
| 1011 | Q41785 | 201:276 | 0.54 | 0.26 | 0.17 | 3 |
| 1012 | O24562 | 126:276 | 0.53 | 0.28 | 0.14 | 1 |
| 1013 | Q6ZHS4 | 126:301 | 0.52 | 0.27 | 0.13 | 1 |
| 1014 | Q6ERW7 | 226:301 | 0.55 | 0.29 | 0.13 | 1 |
| 1015 | Q01595 | 51:126 | 0.52 | 0.36 | 0.22 | 7 |
| 1016 | Q6ERW9 | 226:301 | 0.54 | 0.29 | 0.13 | 1 |
| 1017 | Q0J6T3 | 151:276 | 0.55 | 0.28 | 0.13 | 1 |
| 1018 | P93203 | 201:276 | 0.55 | 0.25 | 0.18 | 0 |
| 1019 | Q7XWU3 | 151:276 | 0.52 | 0.27 | 0.14 | 1 |
| 1020 | Q41874 | 126:251 | 0.51 | 0.29 | 0.16 | 2 |
| 1021 | Q8H859 | 151:276 | 0.54 | 0.25 | 0.14 | 1 |
| 1022 | P0CD58 | 301:476 | 0.53 | 0.32 | 0.18 | 3 |
| 1023 | P0CD59 | 301:476 | 0.53 | 0.32 | 0.18 | 3 |
| 1024 | O04161 | 251:376 | 0.58 | 0.26 | 0.13 | 5 |
| 1025 | Q2R114 | 151:276 | 0.54 | 0.26 | 0.13 | 1 |
| 1026 | Q5Z987 | 1051:1276 | 0.54 | 0.30 | 0.14 | 3 |
| 1027 | Q41808 | 176:276 | 0.51 | 0.28 | 0.17 | 2 |
| 1028 | Q41807 | 176:276 | 0.51 | 0.29 | 0.17 | 2 |
| 1029 | P54773 | 101:276 | 0.55 | 0.29 | 0.15 | 0 |
| 1030 | Q5Z987 | 1151:1251 | 0.60 | 0.34 | 0.14 | 2 |
| 1031 | Q5Z987 | 1151:1351 | 0.54 | 0.33 | 0.16 | 4 |
| 1032 | P31542 | 326:401 | 0.53 | 0.30 | 0.14 | 0 |
| 1033 | P31541 | 126:201 | 0.51 | 0.32 | 0.15 | 0 |
| 1034 | P04706 | 1:76 | 0.51 | 0.31 | 0.17 | 2 |
| 1035 | O64411 | 1:76 | 0.53 | 0.32 | 0.18 | 0 |
| 1036 | Q0J149 | 351:426 | 0.60 | 0.26 | 0.17 | 0 |

TABLE 4A-continued

| Seq ID No | UniProt | FragEnds | EAA | BCAA | L | C |
|---|---|---|---|---|---|---|
| 1037 | Q9XGC9 | 476:551 | 0.57 | 0.26 | 0.13 | 0 |
| 1038 | P93648 | 326:401 | 0.51 | 0.25 | 0.17 | 1 |
| 1039 | Q6H7U5 | 376:451 | 0.56 | 0.26 | 0.14 | 0 |
| 1040 | Q43143 | 76:176 | 0.52 | 0.26 | 0.14 | 2 |
| 1041 | Q9LGV5 | 51:126 | 0.52 | 0.27 | 0.14 | 0 |
| 1042 | P0C8M8 | 126:201 | 0.51 | 0.26 | 0.16 | 4 |
| 1043 | Q05761 | 51:126 | 0.56 | 0.32 | 0.16 | 0 |
| 1044 | Q84NP7 | 326:426 | 0.54 | 0.26 | 0.16 | 1 |
| 1045 | Q75HC2 | 276:351 | 0.51 | 0.27 | 0.14 | 2 |
| 1046 | Q6QNU4 | 126:201 | 0.52 | 0.27 | 0.14 | 2 |
| 1047 | Q5JMF2 | 51:126 | 0.55 | 0.26 | 0.14 | 4 |
| 1048 | Q7XU38 | 276:351 | 0.54 | 0.25 | 0.16 | 1 |
| 1049 | Q8GUQ5 | 1076:1151 | 0.53 | 0.27 | 0.16 | 2 |
| 1050 | P51059 | 76:176 | 0.52 | 0.27 | 0.14 | 0 |
| 1051 | P0C8M8 | 26:176 | 0.54 | 0.27 | 0.14 | 6 |
| 1052 | P49037 | 26:101 | 0.51 | 0.29 | 0.15 | 0 |
| 1053 | O49187 | 101:176 | 0.56 | 0.30 | 0.18 | 0 |
| 1054 | Q0J4I1 | 26:176 | 0.52 | 0.25 | 0.14 | 2 |
| 1055 | Q6ZAG3 | 51:176 | 0.53 | 0.25 | 0.13 | 1 |
| 1056 | P29620 | 51:126 | 0.54 | 0.27 | 0.14 | 0 |
| 1057 | P33544 | 201:276 | 0.54 | 0.26 | 0.15 | 1 |
| 1058 | O24573 | 1:101 | 0.55 | 0.28 | 0.14 | 2 |
| 1059 | Q3HRN8 | 126:201 | 0.55 | 0.26 | 0.15 | 0 |
| 1060 | Q3HRP5 | 1:101 | 0.53 | 0.27 | 0.15 | 3 |
| 1061 | P93647 | 801:876 | 0.53 | 0.32 | 0.16 | 0 |
| 1062 | Q9ZS62 | 951:1026 | 0.53 | 0.35 | 0.16 | 0 |
| 1063 | Q6Z4U2 | 276:351 | 0.53 | 0.29 | 0.13 | 1 |
| 1064 | P29185 | 201:301 | 0.57 | 0.31 | 0.13 | 1 |
| 1065 | Q75LU8 | 1:76 | 0.51 | 0.31 | 0.19 | 4 |
| 1066 | Q43298 | 201:301 | 0.55 | 0.31 | 0.13 | 1 |
| 1067 | P49971 | 26:101 | 0.52 | 0.27 | 0.13 | 2 |
| 1068 | P46641 | 1:76 | 0.64 | 0.26 | 0.16 | 1 |
| 1069 | Q2QMX9 | 701:776 | 0.52 | 0.25 | 0.14 | 0 |
| 1070 | Q43270 | 226:301 | 0.53 | 0.25 | 0.13 | 0 |
| 1071 | P93841 | 76:176 | 0.52 | 0.26 | 0.15 | 1 |
| 1072 | P10581 | 151:226 | 0.52 | 0.29 | 0.14 | 1 |
| 1073 | P93647 | 151:251 | 0.51 | 0.26 | 0.14 | 0 |
| 1074 | Q2QQS5 | 126:201 | 0.52 | 0.30 | 0.13 | 0 |
| 1075 | Q0JNK5 | 301:426 | 0.52 | 0.34 | 0.15 | 1 |

TABLE 4B

| Seq ID No | SolvScore | AggScore | Allergenicity | Toxicity | Antinutricity | Human Homology |
|---|---|---|---|---|---|---|
| 1001 | −7.76 | 1.07 | 0.63 | 0.00 | 0.00 | 0.28 |
| 1002 | −16.11 | 0.62 | 0.49 | 0.24 | 0.26 | 0.87 |
| 1003 | −11.65 | 0.84 | 0.48 | 0.00 | 0.29 | 0.54 |
| 1004 | −13.93 | 0.66 | 0.46 | 0.00 | 0.27 | 0.87 |
| 1005 | −15.37 | 0.78 | 0.45 | 0.32 | 0.00 | 0.47 |
| 1006 | −14.07 | 0.63 | 0.45 | 0.00 | 0.27 | 0.86 |
| 1007 | −14.01 | 0.63 | 0.45 | 0.00 | 0.27 | 0.87 |
| 1008 | −14.01 | 0.63 | 0.45 | 0.00 | 0.27 | 0.87 |
| 1009 | −14.01 | 0.63 | 0.45 | 0.00 | 0.27 | 0.87 |
| 1010 | −14.01 | 0.63 | 0.45 | 0.00 | 0.27 | 0.87 |
| 1011 | −14.01 | 0.63 | 0.45 | 0.00 | 0.27 | 0.87 |
| 1012 | −14.02 | 0.70 | 0.44 | 0.24 | 0.27 | 0.29 |
| 1013 | −13.33 | 0.73 | 0.42 | 0.00 | 0.26 | 0.27 |
| 1014 | −10.77 | 0.79 | 0.42 | 0.00 | 0.30 | 0.34 |
| 1015 | −14.67 | 0.92 | 0.40 | 0.31 | 0.29 | 0.28 |
| 1016 | −13.59 | 0.79 | 0.39 | 0.00 | 0.29 | 0.35 |
| 1017 | −13.51 | 0.76 | 0.39 | 0.00 | 0.00 | 0.28 |
| 1018 | −35.15 | 0.19 | 0.38 | 0.00 | 0.00 | 0.35 |
| 1019 | −16.25 | 0.65 | 0.38 | 0.22 | 0.00 | 0.27 |
| 1020 | −13.96 | 0.54 | 0.38 | 0.00 | 0.00 | 0.83 |
| 1021 | −15.75 | 0.75 | 0.37 | 0.22 | 0.22 | 0.27 |
| 1022 | −9.84 | 1.10 | 0.36 | 0.00 | 0.25 | 0.26 |
| 1023 | −9.84 | 1.10 | 0.36 | 0.00 | 0.25 | 0.26 |
| 1024 | −9.79 | 0.97 | 0.36 | 0.27 | 0.24 | 0.29 |
| 1025 | −14.86 | 0.77 | 0.36 | 0.21 | 0.00 | 0.27 |
| 1026 | −20.01 | 0.60 | 0.36 | 0.00 | 0.00 | 0.20 |
| 1027 | −11.76 | 0.58 | 0.36 | 0.00 | 0.00 | 0.85 |
| 1028 | −11.75 | 0.58 | 0.36 | 0.00 | 0.00 | 0.85 |
| 1029 | −14.00 | 0.90 | 0.36 | 0.00 | 0.25 | 0.26 |
| 1030 | −19.70 | 0.84 | 0.35 | 0.00 | 0.21 | 0.00 |

TABLE 4B-continued

| Seq ID No | SolvScore | AggScore | Allergenicity | Toxicity | Antinutricity | Human Homology |
|---|---|---|---|---|---|---|
| 1031 | −19.59 | 0.71 | 0.35 | 0.00 | 0.17 | 0.24 |
| 1032 | −24.74 | 0.63 | 0.28 | 0.67 | 0.29 | 0.00 |
| 1033 | −20.05 | 0.57 | 0.24 | 0.40 | 0.28 | 0.30 |
| 1034 | −4.01 | 0.67 | 0.31 | 0.40 | 0.38 | 0.43 |
| 1035 | −10.91 | 1.01 | 0.29 | 0.39 | 0.34 | 0.42 |
| 1036 | −30.64 | 0.41 | 0.27 | 0.00 | 0.30 | 0.00 |
| 1037 | −27.88 | 0.25 | 0.23 | 0.00 | 0.00 | 0.31 |
| 1038 | −27.52 | 0.30 | 0.27 | 0.00 | 0.27 | 0.64 |
| 1039 | −27.42 | 0.47 | 0.29 | 0.00 | 0.00 | 0.00 |
| 1040 | −27.42 | 0.29 | 0.32 | 0.00 | 0.27 | 0.00 |
| 1041 | −26.41 | 0.31 | 0.26 | 0.00 | 0.29 | 0.53 |
| 1042 | −26.11 | 0.38 | 0.28 | 0.22 | 0.28 | 0.66 |
| 1043 | −25.86 | 0.56 | 0.25 | 0.00 | 0.26 | 0.79 |
| 1044 | −25.75 | 0.31 | 0.32 | 0.00 | 0.28 | 0.58 |
| 1045 | −25.74 | 0.51 | 0.27 | 0.29 | 0.30 | 0.31 |
| 1046 | −25.62 | 0.48 | 0.26 | 0.30 | 0.21 | 0.66 |
| 1047 | −25.19 | 0.41 | 0.27 | 0.32 | 0.29 | 0.26 |
| 1048 | −25.11 | 0.72 | 0.28 | 0.00 | 0.28 | 0.36 |
| 1049 | −24.99 | 0.51 | 0.21 | 0.27 | 0.27 | 0.34 |
| 1050 | −24.92 | 0.42 | 0.28 | 0.00 | 0.00 | 0.00 |
| 1051 | −24.77 | 0.34 | 0.30 | 0.26 | 0.24 | 0.50 |
| 1052 | −24.70 | 0.55 | 0.26 | 0.00 | 0.22 | 0.32 |
| 1053 | −24.58 | 0.52 | 0.25 | 0.00 | 0.00 | 0.00 |
| 1054 | −24.51 | 0.39 | 0.33 | 0.00 | 0.00 | 0.52 |
| 1055 | −24.44 | 0.27 | 0.31 | 0.26 | 0.00 | 0.46 |
| 1056 | −24.32 | 0.51 | 0.27 | 0.00 | 0.00 | 0.56 |
| 1057 | −24.32 | 0.57 | 0.25 | 0.00 | 0.31 | 0.00 |
| 1058 | −24.14 | 0.55 | 0.31 | 0.00 | 0.28 | 0.48 |
| 1059 | −24.14 | 0.48 | 0.29 | 0.00 | 0.30 | 0.41 |
| 1060 | −23.96 | 0.56 | 0.34 | 0.00 | 0.26 | 0.30 |
| 1061 | −23.86 | 0.55 | 0.26 | 0.00 | 0.26 | 0.58 |
| 1062 | −23.81 | 0.67 | 0.23 | 0.00 | 0.24 | 0.00 |
| 1063 | −23.35 | 0.63 | 0.23 | 0.26 | 0.26 | 0.28 |
| 1064 | −23.30 | 0.56 | 0.28 | 0.00 | 0.00 | 0.56 |
| 1065 | −23.28 | 0.63 | 0.33 | 0.26 | 0.30 | 0.27 |
| 1066 | −23.25 | 0.56 | 0.29 | 0.00 | 0.27 | 0.55 |
| 1067 | −23.24 | 0.32 | 0.28 | 0.29 | 0.28 | 0.50 |
| 1068 | −23.20 | 0.71 | 0.29 | 0.33 | 0.25 | 0.27 |
| 1069 | −22.91 | 0.44 | 0.27 | 0.00 | 0.30 | 0.53 |
| 1070 | −22.86 | 0.47 | 0.28 | 0.31 | 0.25 | 0.34 |
| 1071 | −22.79 | 0.51 | 0.29 | 0.25 | 0.25 | 0.25 |
| 1072 | −22.76 | 0.62 | 0.25 | 0.00 | 0.00 | 0.00 |
| 1073 | −22.76 | 0.47 | 0.30 | 0.00 | 0.00 | 0.31 |
| 1074 | −22.72 | 0.56 | 0.27 | 0.00 | 0.21 | 0.31 |
| 1075 | −22.70 | 0.75 | 0.30 | 0.00 | 0.00 | 0.51 |

Example 3

Identification of Protein Fragments Containing Ratios of Essential Amino Acids and Branch Chain Amino Acids Greater than or Equal to Whey and Containing all Essential Amino Acids Fragments from the set of 8,415 proteins described in Example 1 were evaluated for amino acid content, percentage of essential amino acids ("EAA"), the percentage of branched chain amino acids ("BCAA"), the percentage of leucine ("L"), and whether the protein contained all of the essential amino acids were calculated for each protein. In addition, the protein fragments were screened against a database of known allergens to determine whether any had greater than 50% global homology to a known allergen. A total of 485 proteins were identified that contain greater than or equal to 51% EAA and greater than or equal to 25% BCAA, and that contain all essential amino acids, and have less than 50% global homology to known allergens (SEQ ID NOS: 1415 to 1899). For the set of protein fragments the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated, and the total number of Cys residues ("C") were determined. The characteristics of 75 representative proteins thus identified are presented in Table 5A and 4B.

TABLE 5A

| Seq ID No | UniProt | FragEnds | EAA | BCAA | L | C |
|---|---|---|---|---|---|---|
| 1415 | Q96576 | 151:326 | 0.52 | 0.27 | 0.10 | 2 |
| 1416 | P15722 | 176:276 | 0.53 | 0.28 | 0.04 | 1 |
| 1417 | Q8GUQ5 | 876:1001 | 0.51 | 0.25 | 0.12 | 1 |
| 1418 | P17801 | 476:751 | 0.52 | 0.26 | 0.12 | 3 |
| 1419 | Q6ERW7 | 201:351 | 0.53 | 0.26 | 0.10 | 1 |
| 1420 | Q7XWU3 | 51:276 | 0.51 | 0.25 | 0.09 | 6 |
| 1421 | Q6ER94 | 76:226 | 0.52 | 0.26 | 0.10 | 1 |
| 1422 | Q43272 | 176:376 | 0.52 | 0.26 | 0.10 | 6 |
| 1423 | Q43272 | 76:326 | 0.52 | 0.28 | 0.11 | 7 |
| 1424 | Q6ERW9 | 226:351 | 0.55 | 0.26 | 0.11 | 1 |
| 1425 | Q10717 | 251:326 | 0.51 | 0.30 | 0.10 | 1 |
| 1426 | Q6ERW9 | 126:276 | 0.51 | 0.25 | 0.06 | 5 |
| 1427 | Q6ERW5 | 26:101 | 0.52 | 0.25 | 0.03 | 4 |
| 1428 | P16243 | 226:476 | 0.51 | 0.27 | 0.12 | 4 |

TABLE 5A-continued

| Seq ID No | UniProt | FragEnds | EAA | BCAA | L | C |
|---|---|---|---|---|---|---|
| 1429 | Q43272 | 76:226 | 0.51 | 0.28 | 0.12 | 4 |
| 1430 | O04161 | 151:376 | 0.55 | 0.25 | 0.11 | 5 |
| 1431 | Q9ATN1 | 101:251 | 0.56 | 0.29 | 0.11 | 2 |
| 1432 | Q9ATN1 | 1:251 | 0.51 | 0.25 | 0.10 | 5 |
| 1433 | P29185 | 26:301 | 0.52 | 0.25 | 0.08 | 3 |
| 1434 | Q08451 | 126:276 | 0.53 | 0.27 | 0.08 | 2 |
| 1435 | Q96575 | 1:276 | 0.52 | 0.26 | 0.12 | 4 |
| 1436 | P09607 | 1:276 | 0.51 | 0.26 | 0.12 | 5 |
| 1437 | Q6ETN3 | 401:501 | 0.52 | 0.25 | 0.06 | 0 |
| 1438 | Q5BQN5 | 151:226 | 0.60 | 0.26 | 0.11 | 1 |
| 1439 | Q2MI42 | 976:1176 | 0.64 | 0.25 | 0.10 | 0 |
| 1440 | P28523 | 26:176 | 0.51 | 0.26 | 0.09 | 3 |
| 1441 | Q8H6B1 | 126:226 | 0.57 | 0.26 | 0.10 | 1 |
| 1442 | P54767 | 176:251 | 0.54 | 0.26 | 0.11 | 1 |
| 1443 | Q67W82 | 401:526 | 0.51 | 0.26 | 0.06 | 0 |
| 1444 | P0C8M8 | 1:226 | 0.53 | 0.25 | 0.11 | 7 |
| 1445 | Q9FYT6 | 551:651 | 0.53 | 0.25 | 0.09 | 0 |
| 1446 | P0C8M8 | 151:226 | 0.52 | 0.26 | 0.12 | 2 |
| 1447 | Q10S72 | 426:551 | 0.52 | 0.26 | 0.10 | 1 |
| 1448 | Q42982 | 426:551 | 0.53 | 0.26 | 0.06 | 0 |
| 1449 | Q2MI46 | 26:101 | 0.51 | 0.25 | 0.09 | 4 |
| 1450 | B4G0F3 | 276:401 | 0.52 | 0.26 | 0.07 | 1 |
| 1451 | P93648 | 76:251 | 0.52 | 0.26 | 0.12 | 1 |
| 1452 | C1K5M3 | 551:751 | 0.55 | 0.25 | 0.12 | 5 |
| 1453 | Q41741 | 151:276 | 0.53 | 0.27 | 0.12 | 1 |
| 1454 | O22424 | 151:251 | 0.60 | 0.25 | 0.05 | 0 |
| 1455 | Q9XFH3 | 51:201 | 0.54 | 0.26 | 0.10 | 3 |
| 1456 | Q7XTS4 | 201:451 | 0.51 | 0.25 | 0.11 | 3 |
| 1457 | Q9FUZ0 | 176:276 | 0.52 | 0.25 | 0.12 | 2 |
| 1458 | P05118 | 1:76 | 0.59 | 0.26 | 0.10 | 1 |
| 1459 | Q8S7E1 | 51:126 | 0.52 | 0.27 | 0.12 | 1 |
| 1460 | C1K5M2 | 101:201 | 0.55 | 0.25 | 0.10 | 3 |
| 1461 | Q6Z4U2 | 151:351 | 0.52 | 0.26 | 0.12 | 4 |
| 1462 | Q8H6B1 | 26:176 | 0.56 | 0.25 | 0.11 | 0 |
| 1463 | Q0J7J7 | 176:351 | 0.51 | 0.27 | 0.11 | 5 |
| 1464 | P10581 | 651:751 | 0.51 | 0.27 | 0.12 | 1 |
| 1465 | Q2RAS0 | 26:251 | 0.51 | 0.25 | 0.09 | 2 |
| 1466 | O24594 | 351:426 | 0.53 | 0.29 | 0.08 | 2 |
| 1467 | Q0J7J7 | 276:351 | 0.54 | 0.31 | 0.12 | 3 |
| 1468 | Q6XZ79 | 176:276 | 0.51 | 0.25 | 0.10 | 1 |
| 1469 | P19862 | 651:801 | 0.53 | 0.26 | 0.11 | 3 |
| 1470 | P28554 | 276:426 | 0.53 | 0.26 | 0.11 | 2 |
| 1471 | C1K5M3 | 451:651 | 0.52 | 0.25 | 0.12 | 4 |
| 1472 | P31927 | 451:551 | 0.51 | 0.26 | 0.12 | 1 |
| 1473 | Q65X71 | 451:526 | 0.61 | 0.31 | 0.12 | 0 |
| 1474 | Q00497 | 76:226 | 0.51 | 0.25 | 0.11 | 4 |
| 1475 | Q7XKC0 | 76:176 | 0.51 | 0.26 | 0.06 | 3 |
| 1476 | P10582 | 276:451 | 0.55 | 0.27 | 0.12 | 3 |
| 1477 | P29535 | 176:401 | 0.51 | 0.26 | 0.11 | 8 |
| 1478 | Q43298 | 26:301 | 0.51 | 0.25 | 0.08 | 3 |
| 1479 | Q7XRA1 | 176:251 | 0.61 | 0.29 | 0.12 | 0 |
| 1480 | Q852N2 | 826:1001 | 0.52 | 0.27 | 0.12 | 6 |
| 1481 | Q65X71 | 451:726 | 0.52 | 0.26 | 0.09 | 5 |
| 1482 | Q852N2 | 826:901 | 0.51 | 0.25 | 0.10 | 2 |
| 1483 | Q65X71 | 51:326 | 0.52 | 0.27 | 0.10 | 3 |
| 1484 | Q8H6B1 | 801:901 | 0.57 | 0.29 | 0.12 | 1 |
| 1485 | P54767 | 176:451 | 0.52 | 0.26 | 0.10 | 2 |
| 1486 | P61242 | 1626:1876 | 0.51 | 0.27 | 0.12 | 4 |
| 1487 | Q65X71 | 451:626 | 0.54 | 0.26 | 0.09 | 3 |
| 1488 | P04712 | 326:426 | 0.52 | 0.27 | 0.11 | 1 |
| 1489 | Q75LR2 | 351:426 | 0.55 | 0.28 | 0.12 | 0 |

TABLE 5B

| Seq ID No | SolvScore | AggScore | Allergenicity | Toxicity | Antinutricity | Human Homology |
|---|---|---|---|---|---|---|
| 1415 | −16.93 | 0.58 | 0.54 | 0.53 | 0.24 | 0.00 |
| 1416 | −19.58 | 0.41 | 0.53 | 0.00 | 0.21 | 0.00 |
| 1417 | −21.91 | 0.46 | 0.47 | 0.27 | 0.27 | 0.37 |
| 1418 | −19.73 | 0.54 | 0.46 | 0.00 | 0.00 | 0.34 |
| 1419 | −11.15 | 0.74 | 0.43 | 0.00 | 0.25 | 0.29 |
| 1420 | −16.57 | 0.61 | 0.42 | 0.22 | 0.00 | 0.27 |
| 1421 | −20.09 | 0.54 | 0.41 | 0.23 | 0.00 | 0.63 |
| 1422 | −16.36 | 0.68 | 0.41 | 0.00 | 0.24 | 0.34 |
| 1423 | −16.55 | 0.67 | 0.40 | 0.00 | 0.21 | 0.32 |
| 1424 | −11.31 | 0.79 | 0.40 | 0.24 | 0.00 | 0.27 |
| 1425 | −17.05 | 0.64 | 0.39 | 0.28 | 0.35 | 0.53 |
| 1426 | −11.49 | 0.73 | 0.38 | 0.00 | 0.26 | 0.35 |
| 1427 | −17.25 | 0.63 | 0.38 | 0.25 | 0.28 | 0.41 |
| 1428 | −19.07 | 0.59 | 0.38 | 0.21 | 0.00 | 0.60 |
| 1429 | −16.46 | 0.67 | 0.36 | 0.25 | 0.23 | 0.33 |
| 1430 | −11.00 | 0.89 | 0.36 | 0.00 | 0.00 | 0.26 |
| 1431 | −6.06 | 1.08 | 0.36 | 0.27 | 0.27 | 0.36 |
| 1432 | −8.76 | 0.87 | 0.36 | 0.23 | 0.23 | 0.28 |
| 1433 | −21.28 | 0.49 | 0.36 | 0.00 | 0.00 | 0.60 |
| 1434 | −10.55 | 0.95 | 0.35 | 0.25 | 0.24 | 0.44 |
| 1435 | −17.94 | 0.61 | 0.34 | 0.37 | 0.00 | 0.00 |
| 1436 | −18.54 | 0.63 | 0.33 | 0.36 | 0.19 | 0.00 |
| 1437 | −28.54 | 0.46 | 0.30 | 0.00 | 0.23 | 0.38 |
| 1438 | −25.54 | 0.40 | 0.27 | 0.00 | 0.00 | 0.26 |
| 1439 | −25.12 | 0.37 | 0.33 | 0.24 | 0.00 | 0.19 |
| 1440 | −25.09 | 0.34 | 0.31 | 0.00 | 0.21 | 0.80 |
| 1441 | −24.93 | 0.38 | 0.32 | 0.00 | 0.25 | 0.27 |
| 1442 | −24.55 | 0.45 | 0.22 | 0.00 | 0.00 | 0.32 |
| 1443 | −24.41 | 0.49 | 0.29 | 0.24 | 0.00 | 0.33 |
| 1444 | −24.26 | 0.36 | 0.31 | 0.00 | 0.00 | 0.49 |
| 1445 | −23.95 | 0.53 | 0.28 | 0.00 | 0.00 | 0.00 |
| 1446 | −23.76 | 0.45 | 0.30 | 0.00 | 0.26 | 0.70 |
| 1447 | −23.69 | 0.45 | 0.30 | 0.24 | 0.27 | 0.39 |
| 1448 | −23.58 | 0.48 | 0.31 | 0.00 | 0.24 | 0.36 |
| 1449 | −23.51 | 0.56 | 0.27 | 0.25 | 0.27 | 0.36 |
| 1450 | −23.40 | 0.48 | 0.31 | 0.25 | 0.00 | 0.43 |
| 1451 | −23.21 | 0.41 | 0.30 | 0.00 | 0.22 | 0.27 |
| 1452 | −23.11 | 0.50 | 0.30 | 0.00 | 0.23 | 0.00 |
| 1453 | −22.98 | 0.53 | 0.30 | 0.29 | 0.26 | 0.71 |

TABLE 5B-continued

| Seq ID No | SolvScore | AggScore | Allergenicity | Toxicity | Antinutricity | Human Homology |
|---|---|---|---|---|---|---|
| 1454 | −22.62 | 0.40 | 0.27 | 0.00 | 0.00 | 0.70 |
| 1455 | −22.54 | 0.48 | 0.31 | 0.24 | 0.24 | 0.42 |
| 1456 | −22.52 | 0.37 | 0.33 | 0.24 | 0.00 | 0.30 |
| 1457 | −22.50 | 0.44 | 0.30 | 0.00 | 0.00 | 0.44 |
| 1458 | −22.49 | 0.61 | 0.27 | 0.24 | 1.00 | 0.26 |
| 1459 | −22.48 | 0.47 | 0.23 | 0.00 | 0.27 | 0.24 |
| 1460 | −22.30 | 0.61 | 0.30 | 0.23 | 0.19 | 0.36 |
| 1461 | −22.29 | 0.45 | 0.30 | 0.21 | 0.24 | 0.00 |
| 1462 | −22.25 | 0.48 | 0.31 | 0.00 | 0.21 | 0.29 |
| 1463 | −22.20 | 0.44 | 0.30 | 0.00 | 0.22 | 0.00 |
| 1464 | −22.05 | 0.53 | 0.28 | 0.00 | 0.00 | 0.00 |
| 1465 | −22.05 | 0.69 | 0.30 | 0.00 | 0.00 | 0.29 |
| 1466 | −22.02 | 0.45 | 0.29 | 0.00 | 0.32 | 0.54 |
| 1467 | −22.00 | 0.48 | 0.27 | 0.00 | 0.30 | 0.32 |
| 1468 | −21.97 | 0.50 | 0.29 | 0.00 | 0.00 | 0.31 |
| 1469 | −21.83 | 0.54 | 0.30 | 0.23 | 0.00 | 0.00 |
| 1470 | −21.80 | 0.58 | 0.31 | 0.25 | 0.00 | 0.23 |
| 1471 | −21.78 | 0.56 | 0.30 | 0.21 | 0.23 | 0.00 |
| 1472 | −21.60 | 0.54 | 0.30 | 0.00 | 0.00 | 0.00 |
| 1473 | −21.53 | 0.69 | 0.24 | 0.00 | 0.26 | 0.33 |
| 1474 | −21.44 | 0.48 | 0.33 | 0.21 | 0.00 | 0.27 |
| 1475 | −21.39 | 0.65 | 0.28 | 0.26 | 0.00 | 0.59 |
| 1476 | −21.27 | 0.57 | 0.30 | 0.00 | 0.24 | 0.00 |
| 1477 | −21.26 | 0.50 | 0.33 | 0.00 | 0.23 | 0.30 |
| 1478 | −21.26 | 0.49 | 0.32 | 0.00 | 0.00 | 0.60 |
| 1479 | −21.13 | 0.55 | 0.28 | 0.00 | 0.00 | 0.28 |
| 1480 | −21.08 | 0.61 | 0.33 | 0.17 | 0.24 | 0.27 |
| 1481 | −21.00 | 0.50 | 0.31 | 0.19 | 0.22 | 0.39 |
| 1482 | −20.97 | 0.43 | 0.24 | 0.17 | 0.26 | 0.00 |
| 1483 | −20.94 | 0.68 | 0.33 | 0.00 | 0.23 | 0.34 |
| 1484 | −20.89 | 0.61 | 0.29 | 0.00 | 0.26 | 0.51 |
| 1485 | −20.84 | 0.48 | 0.31 | 0.00 | 0.00 | 0.23 |
| 1486 | −20.74 | 0.51 | 0.30 | 0.00 | 0.22 | 0.22 |
| 1487 | −20.65 | 0.51 | 0.31 | 0.28 | 0.27 | 0.34 |
| 1488 | −20.58 | 0.44 | 0.32 | 0.00 | 0.00 | 0.00 |
| 1489 | −20.54 | 0.44 | 0.28 | 0.00 | 0.00 | 0.21 |

Example 4

Identification of Protein Fragments Containing Ratios of Essential Amino Acids and Leucine Greater than or Equal to Whey and Containing all Essential Amino Acids Fragments from the set of 8,415 proteins described in Example 1 were evaluated for amino acid content, percentage of essential amino acids ("EAA"), the percentage of branched chain amino acids ("BCAA"), the percentage of leucine ("L"), and whether the protein contained all of the essential amino acids were calculated for each protein. In addition, the protein fragments were screened against a database of known allergens to determine whether any had greater than 50% global homology to a known allergen. A total of 203 protein fragments were identified that contain greater than or equal to 51% EAA and greater than or equal to 13% Leu, and that contain all essential amino acids, and have less than 50% global homology to known allergens (SEQ ID NOS: 1900 to 2102). For the set of protein fragments the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated, and the total number of Cys residues ("C") were determined. The characteristics of 75 representative protein fragments thus identified are presented in Table 6A and 6B.

TABLE 6A

| Seq ID No | UniProt | FragEnds | EAA | BCAA | L | C |
|---|---|---|---|---|---|---|
| 1900 | Q41784 | 201:301 | 0.51 | 0.22 | 0.15 | 4 |
| 1901 | P18025 | 201:301 | 0.51 | 0.22 | 0.15 | 4 |
| 1902 | Q43697 | 201:301 | 0.51 | 0.22 | 0.15 | 4 |
| 1903 | Q41783 | 201:301 | 0.51 | 0.22 | 0.15 | 4 |
| 1904 | Q41785 | 201:301 | 0.51 | 0.22 | 0.15 | 4 |
| 1905 | P18026 | 201:301 | 0.51 | 0.22 | 0.15 | 4 |
| 1906 | P10708 | 76:176 | 0.51 | 0.24 | 0.13 | 1 |
| 1907 | P27525 | 51:151 | 0.53 | 0.22 | 0.14 | 0 |
| 1908 | Q3HRN9 | 51:201 | 0.52 | 0.23 | 0.14 | 1 |
| 1909 | Q9ZSV1 | 726:801 | 0.51 | 0.23 | 0.14 | 1 |
| 1910 | Q5BQN5 | 51:176 | 0.52 | 0.20 | 0.13 | 1 |
| 1911 | P56669 | 1:76 | 0.53 | 0.18 | 0.14 | 1 |
| 1912 | Q75LU8 | 1:201 | 0.52 | 0.24 | 0.13 | 4 |
| 1913 | Q8S0F0 | 601:851 | 0.51 | 0.23 | 0.14 | 3 |
| 1914 | Q9ZSV1 | 626:801 | 0.51 | 0.23 | 0.13 | 1 |
| 1915 | Q0J149 | 301:451 | 0.53 | 0.23 | 0.14 | 0 |
| 1916 | P93703 | 201:401 | 0.51 | 0.24 | 0.14 | 1 |
| 1917 | Q2MI42 | 426:601 | 0.52 | 0.23 | 0.13 | 1 |
| 1918 | Q8S0F0 | 501:751 | 0.52 | 0.23 | 0.14 | 4 |
| 1919 | Q2MI42 | 1601:1701 | 0.51 | 0.23 | 0.14 | 1 |
| 1920 | Q7XTS3 | 401:476 | 0.57 | 0.21 | 0.13 | 2 |
| 1921 | P49037 | 1:201 | 0.51 | 0.24 | 0.14 | 1 |
| 1922 | Q9FQ11 | 1:76 | 0.53 | 0.24 | 0.16 | 1 |
| 1923 | Q7X996 | 201:376 | 0.55 | 0.22 | 0.13 | 1 |
| 1924 | P27061 | 126:201 | 0.53 | 0.24 | 0.14 | 0 |
| 1925 | P53682 | 326:401 | 0.51 | 0.24 | 0.13 | 1 |
| 1926 | Q84ZL0 | 1201:1476 | 0.51 | 0.24 | 0.16 | 4 |
| 1927 | Q8S0F0 | 701:851 | 0.51 | 0.24 | 0.14 | 1 |
| 1928 | Q6ZAG3 | 51:201 | 0.54 | 0.24 | 0.13 | 1 |
| 1929 | Q69Q02 | 276:451 | 0.52 | 0.22 | 0.13 | 1 |
| 1930 | P10581 | 276:526 | 0.51 | 0.24 | 0.13 | 2 |
| 1931 | P49037 | 201:276 | 0.52 | 0.24 | 0.15 | 2 |
| 1932 | P61242 | 776:951 | 0.51 | 0.23 | 0.15 | 2 |

TABLE 6A-continued

| Seq ID No | UniProt | FragEnds | EAA | BCAA | L | C |
|---|---|---|---|---|---|---|
| 1933 | Q5Z987 | 1826:1926 | 0.51 | 0.19 | 0.14 | 1 |
| 1934 | Q5JMM1 | 251:326 | 0.52 | 0.22 | 0.14 | 0 |
| 1935 | Q84N48 | 426:526 | 0.51 | 0.24 | 0.14 | 0 |
| 1936 | Q7G6K7 | 826:1101 | 0.51 | 0.23 | 0.14 | 4 |
| 1937 | Q0J4I1 | 1:201 | 0.53 | 0.24 | 0.14 | 2 |
| 1938 | Q7XWS7 | 1226:1476 | 0.51 | 0.22 | 0.13 | 3 |
| 1939 | Q0JF02 | 76:276 | 0.51 | 0.24 | 0.14 | 4 |
| 1940 | Q2QN26 | 201:351 | 0.51 | 0.24 | 0.14 | 5 |
| 1941 | P49037 | 101:276 | 0.53 | 0.22 | 0.14 | 2 |
| 1942 | Q6K5F8 | 351:626 | 0.51 | 0.24 | 0.14 | 3 |
| 1943 | Q10QA2 | 101:226 | 0.51 | 0.22 | 0.13 | 6 |
| 1944 | Q9XHR2 | 201:301 | 0.52 | 0.24 | 0.14 | 0 |
| 1945 | Q0DCT8 | 176:351 | 0.52 | 0.24 | 0.15 | 5 |
| 1946 | Q6AU53 | 476:576 | 0.52 | 0.24 | 0.16 | 0 |
| 1947 | A7LFZ6 | 276:451 | 0.52 | 0.23 | 0.15 | 6 |
| 1948 | Q6ZKB2 | 451:726 | 0.52 | 0.22 | 0.13 | 2 |
| 1949 | Q8S983 | 176:251 | 0.51 | 0.22 | 0.14 | 0 |
| 1950 | Q3LXA7 | 526:626 | 0.53 | 0.24 | 0.14 | 2 |
| 1951 | P93703 | 201:276 | 0.55 | 0.24 | 0.14 | 1 |
| 1952 | A3B9A0 | 76:226 | 0.51 | 0.21 | 0.13 | 2 |
| 1953 | Q9XGD6 | 51:126 | 0.52 | 0.22 | 0.13 | 0 |
| 1954 | P18485 | 301:376 | 0.54 | 0.20 | 0.14 | 2 |
| 1955 | Q32SG6 | 876:951 | 0.52 | 0.23 | 0.16 | 0 |
| 1956 | Q5VS72 | 501:576 | 0.54 | 0.24 | 0.18 | 2 |
| 1957 | Q43503 | 401:476 | 0.54 | 0.21 | 0.15 | 1 |
| 1958 | Q42896 | 101:326 | 0.52 | 0.24 | 0.13 | 4 |
| 1959 | Q9MAX6 | 151:251 | 0.52 | 0.24 | 0.14 | 3 |
| 1960 | Q9LKX9 | 1:201 | 0.52 | 0.22 | 0.14 | 5 |
| 1961 | P09562 | 176:301 | 0.52 | 0.23 | 0.15 | 3 |
| 1962 | Q7XWS7 | 1226:1376 | 0.51 | 0.22 | 0.13 | 1 |
| 1963 | Q7XU38 | 151:351 | 0.51 | 0.24 | 0.14 | 4 |
| 1964 | Q69LX2 | 926:1151 | 0.51 | 0.24 | 0.13 | 5 |
| 1965 | Q7XD96 | 601:726 | 0.51 | 0.22 | 0.14 | 5 |
| 1966 | Q7XI73 | 26:101 | 0.52 | 0.17 | 0.13 | 5 |
| 1967 | Q42881 | 301:376 | 0.53 | 0.20 | 0.14 | 3 |
| 1968 | C1K5M3 | 176:301 | 0.53 | 0.23 | 0.14 | 4 |
| 1969 | Q6L4F8 | 226:301 | 0.53 | 0.22 | 0.15 | 2 |
| 1970 | P48022 | 1:101 | 0.51 | 0.23 | 0.14 | 0 |
| 1971 | Q8LHA8 | 51:201 | 0.51 | 0.24 | 0.14 | 3 |
| 1972 | Q6ZAG3 | 151:301 | 0.52 | 0.24 | 0.14 | 3 |
| 1973 | P04711 | 751:901 | 0.53 | 0.24 | 0.13 | 0 |
| 1974 | Q5N870 | 576:801 | 0.53 | 0.23 | 0.13 | 8 |

TABLE 6B

| Seq ID No | SolvScore | AggScore | Allergenicity | Toxicity | Antinutricity | Human Homology |
|---|---|---|---|---|---|---|
| 1900 | −14.31 | 0.56 | 0.48 | 0.00 | 0.25 | 0.88 |
| 1901 | −14.31 | 0.54 | 0.46 | 0.00 | 0.25 | 0.88 |
| 1902 | −14.31 | 0.54 | 0.46 | 0.00 | 0.25 | 0.88 |
| 1903 | −14.31 | 0.54 | 0.46 | 0.00 | 0.25 | 0.88 |
| 1904 | −14.31 | 0.54 | 0.46 | 0.00 | 0.25 | 0.88 |
| 1905 | −14.42 | 0.53 | 0.46 | 0.00 | 0.24 | 0.87 |
| 1906 | −16.21 | 0.63 | 0.41 | 0.00 | 0.00 | 0.28 |
| 1907 | −14.10 | 0.61 | 0.39 | 0.00 | 0.25 | 0.00 |
| 1908 | −24.00 | 0.41 | 0.36 | 0.22 | 0.26 | 0.31 |
| 1909 | −27.98 | 0.27 | 0.25 | 0.29 | 0.33 | 0.49 |
| 1910 | −27.07 | 0.17 | 0.33 | 0.23 | 0.24 | 0.00 |
| 1911 | −27.03 | 0.25 | 0.22 | 0.00 | 0.27 | 0.41 |
| 1912 | −25.61 | 0.41 | 0.35 | 0.23 | 0.25 | 0.32 |
| 1913 | −24.50 | 0.36 | 0.33 | 0.00 | 0.00 | 0.30 |
| 1914 | −24.43 | 0.35 | 0.35 | 0.00 | 0.23 | 0.39 |
| 1915 | −24.41 | 0.37 | 0.32 | 0.24 | 0.23 | 0.00 |
| 1916 | −24.40 | 0.42 | 0.32 | 0.00 | 0.24 | 0.30 |
| 1917 | −24.34 | 0.23 | 0.33 | 0.00 | 0.23 | 0.00 |
| 1918 | −23.77 | 0.39 | 0.32 | 0.00 | 0.00 | 0.34 |
| 1919 | −23.65 | 0.44 | 0.31 | 0.00 | 0.22 | 0.00 |
| 1920 | −23.49 | 0.37 | 0.28 | 0.00 | 0.00 | 0.33 |
| 1921 | −23.32 | 0.40 | 0.33 | 0.22 | 0.25 | 0.00 |
| 1922 | −23.31 | 0.48 | 0.25 | 0.26 | 0.24 | 0.00 |
| 1923 | −23.23 | 0.39 | 0.30 | 0.00 | 0.21 | 0.27 |
| 1924 | −23.18 | 0.42 | 0.24 | 0.00 | 0.00 | 0.00 |
| 1925 | −23.13 | 0.29 | 0.28 | 0.25 | 0.26 | 0.27 |
| 1926 | −23.12 | 0.37 | 0.34 | 0.00 | 0.00 | 0.32 |
| 1927 | −23.00 | 0.35 | 0.34 | 0.00 | 0.25 | 0.29 |
| 1928 | −22.83 | 0.31 | 0.31 | 0.00 | 0.22 | 0.49 |
| 1929 | −22.74 | 0.36 | 0.29 | 0.00 | 0.23 | 0.00 |
| 1930 | −22.67 | 0.39 | 0.31 | 0.00 | 0.00 | 0.00 |
| 1931 | −22.62 | 0.50 | 0.26 | 0.25 | 0.27 | 0.26 |
| 1932 | −22.44 | 0.44 | 0.33 | 0.24 | 0.22 | 0.00 |
| 1933 | −22.39 | 0.41 | 0.31 | 0.22 | 0.25 | 0.34 |
| 1934 | −22.25 | 0.36 | 0.22 | 0.00 | 0.33 | 0.33 |
| 1935 | −22.24 | 0.40 | 0.30 | 0.00 | 0.25 | 0.00 |
| 1936 | −22.14 | 0.35 | 0.32 | 0.00 | 0.00 | 0.31 |
| 1937 | −22.12 | 0.41 | 0.34 | 0.00 | 0.00 | 0.48 |
| 1938 | −21.99 | 0.35 | 0.31 | 0.00 | 0.00 | 0.29 |
| 1939 | −21.98 | 0.49 | 0.33 | 0.00 | 0.23 | 0.00 |
| 1940 | −21.79 | 0.55 | 0.32 | 0.26 | 0.24 | 0.36 |
| 1941 | −21.63 | 0.40 | 0.29 | 0.00 | 0.21 | 0.00 |
| 1942 | −21.60 | 0.42 | 0.33 | 0.00 | 0.24 | 0.65 |
| 1943 | −21.54 | 0.62 | 0.30 | 0.25 | 0.24 | 0.33 |
| 1944 | −21.23 | 0.37 | 0.28 | 0.00 | 0.00 | 0.42 |
| 1945 | −21.20 | 0.48 | 0.32 | 0.00 | 0.25 | 0.40 |
| 1946 | −21.19 | 0.55 | 0.30 | 0.00 | 0.25 | 0.00 |
| 1947 | −21.18 | 0.43 | 0.30 | 0.00 | 0.25 | 0.00 |

TABLE 6B-continued

| Seq ID No | SolvScore | AggScore | Allergenicity | Toxicity | Antinutricity | Human Homology |
|---|---|---|---|---|---|---|
| 1948 | −21.10 | 0.36 | 0.32 | 0.00 | 0.00 | 0.31 |
| 1949 | −20.98 | 0.41 | 0.24 | 0.00 | 0.26 | 0.24 |
| 1950 | −20.85 | 0.56 | 0.30 | 0.00 | 0.24 | 0.37 |
| 1951 | −20.78 | 0.47 | 0.26 | 0.00 | 0.23 | 0.31 |
| 1952 | −20.67 | 0.40 | 0.30 | 0.23 | 0.22 | 0.00 |
| 1953 | −20.65 | 0.55 | 0.26 | 0.00 | 0.00 | 0.37 |
| 1954 | −20.62 | 0.51 | 0.28 | 0.28 | 0.26 | 0.30 |
| 1955 | −20.55 | 0.33 | 0.26 | 0.00 | 0.29 | 0.00 |
| 1956 | −20.51 | 0.45 | 0.26 | 0.28 | 0.00 | 0.46 |
| 1957 | −20.51 | 0.66 | 0.26 | 0.00 | 0.25 | 0.26 |
| 1958 | −20.48 | 0.48 | 0.32 | 0.00 | 0.20 | 0.25 |
| 1959 | −20.40 | 0.55 | 0.32 | 0.00 | 0.26 | 0.56 |
| 1960 | −20.37 | 0.48 | 0.29 | 0.24 | 0.22 | 0.00 |
| 1961 | −20.36 | 0.45 | 0.29 | 0.25 | 0.23 | 0.00 |
| 1962 | −20.34 | 0.33 | 0.30 | 0.23 | 0.24 | 0.30 |
| 1963 | −20.33 | 0.59 | 0.30 | 0.00 | 0.22 | 0.25 |
| 1964 | −20.31 | 0.50 | 0.30 | 0.21 | 0.20 | 0.25 |
| 1965 | −20.18 | 0.36 | 0.29 | 0.30 | 0.21 | 0.32 |
| 1966 | −20.15 | 0.38 | 0.28 | 0.31 | 0.29 | 0.27 |
| 1967 | −20.14 | 0.50 | 0.31 | 0.00 | 0.27 | 0.36 |
| 1968 | −20.11 | 0.36 | 0.27 | 0.00 | 0.00 | 0.00 |
| 1969 | −19.97 | 0.40 | 0.23 | 0.23 | 0.28 | 0.63 |
| 1970 | −19.89 | 0.73 | 0.30 | 0.00 | 0.00 | 0.29 |
| 1971 | −19.81 | 0.55 | 0.32 | 0.22 | 0.22 | 0.31 |
| 1972 | −19.49 | 0.46 | 0.33 | 0.00 | 0.25 | 0.51 |
| 1973 | −19.43 | 0.48 | 0.34 | 0.26 | 0.20 | 0.00 |
| 1974 | −19.42 | 0.46 | 0.32 | 0.00 | 0.00 | 0.26 |

Example 5

Identification of Proteins Containing Ratios of Branch Chain Amino Acids and Leucine Greater than or Equal to Whey and Containing all Essential Amino Acids Fragments from the set of 8,415 proteins described in Example 1 were evaluated for amino acid content, percentage of essential amino acids ("EAA"), the percentage of branched chain amino acids ("BCAA"), the percentage of leucine ("L"), and whether the protein contained all of the essential amino acids were calculated for each protein. In addition, the proteins were screened against a database of known allergens to determine whether any had greater than 50% global homology to a known allergen. A total of 415 protein fragments were identified that contain greater than or equal to 25% BCAA and greater than or equal to 13% Leu, and that contain all essential amino acids, and have less than 50% global homology to known allergens (SEQ ID NOS: 2103 to 2518). For the set of protein fragments the solvation score at pH 7 ("SolvScore"), aggregation score at pH 7 ("AggScore"), allergenicity (i.e., percent local homology to known allergens, as described herein), toxicity (i.e., percent homology to known toxins, as described herein), antinutricity (i.e., percent homology to known protease inhibitors, as described herein), and human homology (i.e., percent homology to known human proteins, as described herein) were calculated, and the total number of Cys residues ("C") were determined. The characteristics of 75 representative protein fragments thus identified are presented in Table 7A and 7B.

TABLE 7A

| Seq ID No | UniProt | FragEnds | EAA | BCAA | L | C |
|---|---|---|---|---|---|---|
| 2103 | O24174 | 76:251 | 0.49 | 0.26 | 0.14 | 4 |
| 2104 | P24396 | 1:126 | 0.48 | 0.27 | 0.13 | 2 |
| 2105 | P17801 | 501:776 | 0.49 | 0.26 | 0.13 | 3 |
| 2106 | O24585 | 501:751 | 0.47 | 0.26 | 0.14 | 3 |
| 2107 | O24585 | 626:751 | 0.46 | 0.29 | 0.14 | 1 |
| 2108 | P42211 | 1:101 | 0.50 | 0.27 | 0.20 | 2 |
| 2109 | Q75L42 | 51:226 | 0.48 | 0.28 | 0.13 | 3 |
| 2110 | Q9LGV5 | 1:251 | 0.48 | 0.26 | 0.13 | 4 |
| 2111 | Q9LGV5 | 101:226 | 0.45 | 0.26 | 0.14 | 3 |
| 2112 | Q10PS6 | 101:276 | 0.47 | 0.26 | 0.13 | 5 |
| 2113 | Q5JLQ9 | 76:226 | 0.47 | 0.26 | 0.15 | 3 |
| 2114 | Q2QMI0 | 26:226 | 0.43 | 0.26 | 0.15 | 3 |
| 2115 | Q0D4B2 | 201:301 | 0.47 | 0.27 | 0.14 | 3 |
| 2116 | Q8GUQ5 | 351:626 | 0.49 | 0.30 | 0.20 | 6 |
| 2117 | Q8GUQ5 | 451:626 | 0.47 | 0.31 | 0.22 | 3 |
| 2118 | Q8GUQ5 | 451:726 | 0.46 | 0.28 | 0.18 | 4 |
| 2119 | Q2QY53 | 126:226 | 0.46 | 0.25 | 0.17 | 3 |
| 2120 | Q2RAX3 | 126:226 | 0.46 | 0.25 | 0.17 | 3 |
| 2121 | Q75GK4 | 1:226 | 0.46 | 0.25 | 0.16 | 3 |
| 2122 | P16243 | 176:376 | 0.49 | 0.28 | 0.13 | 4 |
| 2123 | Q41807 | 151:401 | 0.49 | 0.26 | 0.13 | 3 |
| 2124 | Q69Q47 | 51:226 | 0.49 | 0.27 | 0.14 | 3 |
| 2125 | P46420 | 1:201 | 0.48 | 0.25 | 0.13 | 3 |
| 2126 | Q6Z9F4 | 51:226 | 0.47 | 0.27 | 0.13 | 3 |
| 2127 | P16025 | 1026:1226 | 0.50 | 0.26 | 0.14 | 3 |
| 2128 | P16025 | 926:1151 | 0.45 | 0.26 | 0.13 | 2 |
| 2129 | P49174 | 1:76 | 0.47 | 0.29 | 0.14 | 0 |
| 2130 | P48186 | 1:176 | 0.49 | 0.25 | 0.13 | 1 |
| 2131 | P93648 | 276:401 | 0.50 | 0.26 | 0.16 | 2 |
| 2132 | P49037 | 551:626 | 0.49 | 0.26 | 0.15 | 1 |
| 2133 | Q2MIA9 | 201:276 | 0.48 | 0.28 | 0.15 | 1 |
| 2134 | P16024 | 201:276 | 0.48 | 0.28 | 0.15 | 1 |
| 2135 | P16024 | 201:376 | 0.44 | 0.26 | 0.13 | 2 |
| 2136 | P49037 | 1:101 | 0.49 | 0.27 | 0.14 | 1 |
| 2137 | Q84N48 | 376:451 | 0.49 | 0.27 | 0.13 | 2 |
| 2138 | Q94IW5 | 251:351 | 0.45 | 0.27 | 0.14 | 1 |
| 2139 | Q75LD5 | 576:726 | 0.44 | 0.25 | 0.13 | 1 |
| 2140 | Q84ZX8 | 1:76 | 0.47 | 0.25 | 0.17 | 0 |
| 2141 | Q336R3 | 26:101 | 0.43 | 0.26 | 0.20 | 3 |
| 2142 | P93231 | 576:851 | 0.48 | 0.26 | 0.14 | 6 |
| 2143 | P93648 | 276:551 | 0.48 | 0.25 | 0.13 | 4 |
| 2144 | P16024 | 201:476 | 0.47 | 0.28 | 0.13 | 3 |
| 2145 | Q2NM15 | 26:251 | 0.47 | 0.26 | 0.16 | 3 |

TABLE 7A-continued

| Seq ID No | UniProt | FragEnds | EAA | BCAA | L | C |
|---|---|---|---|---|---|---|
| 2146 | P93231 | 576:751 | 0.50 | 0.25 | 0.14 | 3 |
| 2147 | C7E5V8 | 26:251 | 0.47 | 0.26 | 0.16 | 3 |
| 2148 | C7E5V7 | 26:251 | 0.48 | 0.27 | 0.17 | 3 |
| 2149 | P30792 | 126:226 | 0.49 | 0.28 | 0.15 | 0 |
| 2150 | Q5VS72 | 151:276 | 0.46 | 0.25 | 0.14 | 1 |
| 2151 | Q9XGC9 | 426:501 | 0.45 | 0.27 | 0.16 | 0 |
| 2152 | P61242 | 1626:1776 | 0.47 | 0.28 | 0.14 | 3 |
| 2153 | Q9XGD6 | 126:251 | 0.46 | 0.27 | 0.14 | 2 |
| 2154 | B6SJQ0 | 1:176 | 0.40 | 0.26 | 0.16 | 4 |
| 2155 | P93207 | 1:126 | 0.42 | 0.25 | 0.14 | 2 |
| 2156 | Q653U3 | 801:876 | 0.44 | 0.26 | 0.14 | 1 |
| 2157 | P51059 | 351:576 | 0.44 | 0.25 | 0.15 | 4 |
| 2158 | P07920 | 76:226 | 0.48 | 0.25 | 0.15 | 2 |
| 2159 | P16024 | 301:451 | 0.48 | 0.28 | 0.13 | 2 |
| 2160 | P29390 | 176:251 | 0.50 | 0.25 | 0.14 | 1 |
| 2161 | Q5VQ78 | 576:676 | 0.47 | 0.25 | 0.14 | 0 |
| 2162 | P16025 | 926:1026 | 0.46 | 0.27 | 0.13 | 1 |
| 2163 | P51059 | 476:576 | 0.46 | 0.25 | 0.15 | 1 |
| 2164 | P17847 | 326:451 | 0.38 | 0.25 | 0.16 | 1 |
| 2165 | P05116 | 76:226 | 0.47 | 0.25 | 0.15 | 2 |
| 2166 | P24157 | 76:226 | 0.47 | 0.25 | 0.15 | 2 |
| 2167 | Q9XGC9 | 301:401 | 0.48 | 0.25 | 0.15 | 1 |
| 2168 | P04711 | 351:551 | 0.45 | 0.25 | 0.13 | 3 |
| 2169 | Q84ZW8 | 376:551 | 0.50 | 0.26 | 0.14 | 5 |
| 2170 | Q6H6V4 | 801:876 | 0.45 | 0.26 | 0.13 | 1 |
| 2171 | Q9XGD6 | 26:251 | 0.48 | 0.25 | 0.14 | 2 |
| 2172 | Q41342 | 301:401 | 0.49 | 0.27 | 0.15 | 0 |
| 2173 | Q42883 | 451:626 | 0.45 | 0.25 | 0.14 | 6 |
| 2174 | Q2MI98 | 26:201 | 0.45 | 0.25 | 0.13 | 1 |
| 2175 | Q7XTS4 | 251:426 | 0.49 | 0.26 | 0.13 | 3 |
| 2176 | Q5Z987 | 1276:1451 | 0.47 | 0.25 | 0.14 | 8 |
| 2177 | Q6AVM3 | 276:351 | 0.47 | 0.26 | 0.16 | 2 |

TABLE 7B

| Seq ID No | SolvScore | AggScore | Allergenicity | Toxicity | Antinutricity | Human Homology |
|---|---|---|---|---|---|---|
| 2103 | −17.26 | 0.66 | 0.55 | 0.00 | 0.27 | 0.46 |
| 2104 | −14.60 | 0.68 | 0.49 | 0.25 | 0.26 | 0.23 |
| 2105 | −21.22 | 0.41 | 0.46 | 0.00 | 0.00 | 0.36 |
| 2106 | −19.98 | 0.48 | 0.44 | 0.20 | 0.23 | 0.35 |
| 2107 | −18.81 | 0.59 | 0.44 | 0.00 | 0.00 | 0.40 |
| 2108 | −15.83 | 0.61 | 0.43 | 0.29 | 0.27 | 0.40 |
| 2109 | −20.27 | 0.45 | 0.42 | 0.00 | 0.25 | 0.55 |
| 2110 | −21.01 | 0.39 | 0.42 | 0.00 | 0.00 | 0.51 |
| 2111 | −19.90 | 0.44 | 0.42 | 0.25 | 0.00 | 0.59 |
| 2112 | −13.77 | 0.63 | 0.41 | 0.00 | 0.19 | 0.28 |
| 2113 | −18.33 | 0.59 | 0.40 | 0.27 | 0.23 | 0.53 |
| 2114 | −19.91 | 0.56 | 0.40 | 0.25 | 0.25 | 0.44 |
| 2115 | −17.67 | 0.47 | 0.39 | 0.00 | 0.24 | 0.59 |
| 2116 | −12.97 | 0.46 | 0.39 | 0.00 | 0.24 | 0.32 |
| 2117 | −12.09 | 0.48 | 0.39 | 0.00 | 0.24 | 0.35 |
| 2118 | −13.41 | 0.44 | 0.39 | 0.00 | 0.22 | 0.31 |
| 2119 | −17.69 | 0.50 | 0.38 | 0.00 | 0.00 | 0.55 |
| 2120 | −17.69 | 0.50 | 0.38 | 0.00 | 0.00 | 0.55 |
| 2121 | −18.70 | 0.55 | 0.38 | 0.21 | 0.00 | 0.42 |
| 2122 | −18.11 | 0.64 | 0.38 | 0.00 | 0.24 | 0.61 |
| 2123 | −16.10 | 0.45 | 0.38 | 0.00 | 0.00 | 0.78 |
| 2124 | −19.89 | 0.47 | 0.37 | 0.24 | 0.23 | 0.48 |
| 2125 | −18.94 | 0.60 | 0.37 | 0.24 | 0.25 | 0.28 |
| 2126 | −21.69 | 0.54 | 0.37 | 0.19 | 0.25 | 0.52 |
| 2127 | −17.96 | 0.48 | 0.36 | 0.24 | 0.00 | 0.00 |
| 2128 | −19.80 | 0.48 | 0.36 | 0.20 | 0.00 | 0.00 |
| 2129 | −10.98 | 0.80 | 0.36 | 0.31 | 0.28 | 0.34 |
| 2130 | −20.67 | 0.47 | 0.35 | 0.00 | 0.23 | 0.00 |
| 2131 | −29.02 | 0.26 | 0.33 | 0.26 | 0.24 | 0.60 |
| 2132 | −28.96 | 0.53 | 0.26 | 0.00 | 0.27 | 0.26 |
| 2133 | −28.54 | 0.45 | 0.28 | 0.23 | 0.26 | 0.30 |
| 2134 | −28.35 | 0.49 | 0.25 | 0.27 | 0.00 | 0.23 |
| 2135 | −27.16 | 0.36 | 0.31 | 0.00 | 0.24 | 0.28 |
| 2136 | −25.78 | 0.45 | 0.33 | 0.00 | 0.25 | 0.30 |
| 2137 | −25.22 | 0.53 | 0.27 | 0.19 | 0.00 | 0.33 |
| 2138 | −24.85 | 0.53 | 0.30 | 0.00 | 0.26 | 0.29 |
| 2139 | −24.69 | 0.52 | 0.33 | 0.20 | 0.00 | 0.00 |
| 2140 | −24.65 | 0.46 | 0.24 | 0.00 | 0.30 | 0.27 |
| 2141 | −24.35 | 0.46 | 0.24 | 0.29 | 0.27 | 0.27 |
| 2142 | −24.29 | 0.47 | 0.30 | 0.00 | 0.00 | 0.40 |
| 2143 | −24.22 | 0.34 | 0.33 | 0.22 | 0.00 | 0.67 |
| 2144 | −23.92 | 0.43 | 0.31 | 0.21 | 0.25 | 0.27 |
| 2145 | −23.69 | 0.40 | 0.32 | 0.00 | 0.00 | 0.00 |
| 2146 | −23.69 | 0.50 | 0.30 | 0.00 | 0.20 | 0.43 |
| 2147 | −23.61 | 0.41 | 0.32 | 0.00 | 0.00 | 0.23 |
| 2148 | −23.59 | 0.42 | 0.33 | 0.00 | 0.00 | 0.00 |
| 2149 | −23.57 | 0.39 | 0.31 | 0.00 | 0.27 | 0.00 |
| 2150 | −23.48 | 0.33 | 0.30 | 0.00 | 0.24 | 0.34 |
| 2151 | −23.44 | 0.29 | 0.30 | 0.00 | 0.25 | 0.26 |
| 2152 | −23.42 | 0.51 | 0.30 | 0.00 | 0.23 | 0.27 |
| 2153 | −23.41 | 0.52 | 0.29 | 0.27 | 0.00 | 0.40 |
| 2154 | −23.34 | 0.47 | 0.32 | 0.00 | 0.26 | 0.00 |
| 2155 | −23.10 | 0.47 | 0.34 | 0.20 | 0.22 | 0.54 |

TABLE 7B-continued

| Seq ID No | SolvScore | AggScore | Allergenicity | Toxicity | Antinutricity | Human Homology |
|---|---|---|---|---|---|---|
| 2156 | −23.09 | 0.45 | 0.28 | 0.25 | 0.28 | 0.00 |
| 2157 | −23.07 | 0.47 | 0.32 | 0.00 | 0.21 | 0.00 |
| 2158 | −23.01 | 0.33 | 0.31 | 0.00 | 0.25 | 0.24 |
| 2159 | −22.95 | 0.47 | 0.31 | 0.24 | 0.21 | 0.32 |
| 2160 | −22.81 | 0.26 | 0.26 | 0.00 | 0.00 | 0.42 |
| 2161 | −22.75 | 0.46 | 0.33 | 0.00 | 0.21 | 0.53 |
| 2162 | −22.74 | 0.44 | 0.27 | 0.27 | 0.28 | 0.00 |
| 2163 | −22.72 | 0.54 | 0.30 | 0.00 | 0.28 | 0.24 |
| 2164 | −22.69 | 0.36 | 0.30 | 0.24 | 0.00 | 0.32 |
| 2165 | −22.64 | 0.34 | 0.31 | 0.25 | 0.00 | 0.00 |
| 2166 | −22.64 | 0.34 | 0.31 | 0.25 | 0.00 | 0.00 |
| 2167 | −22.52 | 0.32 | 0.29 | 0.00 | 0.00 | 0.47 |
| 2168 | −22.29 | 0.48 | 0.31 | 0.00 | 0.25 | 0.00 |
| 2169 | −22.23 | 0.51 | 0.32 | 0.19 | 0.22 | 0.00 |
| 2170 | −22.16 | 0.48 | 0.29 | 0.25 | 0.27 | 0.22 |
| 2171 | −22.13 | 0.49 | 0.32 | 0.00 | 0.00 | 0.38 |
| 2172 | −22.05 | 0.63 | 0.34 | 0.00 | 0.00 | 0.00 |
| 2173 | −21.94 | 0.45 | 0.34 | 0.00 | 0.26 | 0.37 |
| 2174 | −21.89 | 0.34 | 0.29 | 0.00 | 0.21 | 0.00 |
| 2175 | −21.84 | 0.41 | 0.33 | 0.00 | 0.25 | 0.28 |
| 2176 | −21.74 | 0.50 | 0.32 | 0.00 | 0.25 | 0.30 |
| 2177 | −21.74 | 0.50 | 0.32 | 0.30 | 0.28 | 0.38 |

Example 6

Protein Expression

Genes encoding nutritive proteins disclosed herein were codon optimized for expression in *Escherichia coli* and synthesized by either LifeTechnologies/GeneArt or DNA 2.0. Genes were designed to contain one of two amino-terminal tags to facilitate purification:

```
MGSHHHHHHHH                      (SEQ ID NO: 2615)

MGSSHHHHHHSSGLVPRGSH             (SEQ ID NO: 2614)
```

These gene constructs were inserted into the pET 15b plasmid vector (Novagen) using NcoI-BamHI restriction sites (in case of the first tag) or using the NdeI-BamHI restriction sites (in the case of the second tag). All restriction enzymes were purchased from New England Biolabs. Plasmids were transformed into *Escherichia coli* T7 Express (New England Biolabs) and selected on lysogeny broth (LB) plates containing 100 mg/l carbenicillin. A single colony was picked, grown to $OD_{600\,nm} \approx 0.6$ in LB with 100 mg/l carbencillin, and stored as a glycerol stock (in LB with 10% glycerol (v/v)) at −80° C., to serve as a master cell stock.

2 ml LB with 100 mg/l carbenicillin (in a 14 mm×100 mm culture tube) was inoculated with a stab from the glycerol stock and grown overnight at 37° C. and 250 rpm. The next day, 2 ml LB with 100 mg/l carbenicillin (in a 14 mm×100 mm culture tube) was inoculated with the overnight culture to $OD_{600\,nm} \approx 0.05$ and grown at 30° C. or 37° C. and 250 rpm. At $OD_{600\,nm} \approx 0.8$, heterologous gene-expression was initiated with 1 mM isopropyl β-D-1-thiogalactopyranoside (IPTG) and grown for another 2 hr (when grown at 37° C.) or 4 hr (when grown at 30° C.) until harvest. Upon harvesting, $OD_{600\,nm}$ was measured, a 1 ml aliquot was centrifuged, and the supernatant was decanted. Cells were re-suspended to $OD_{600\,nm}$=1.50 for SDS-PAGE analysis to evaluate expression level. 10 μl of resuspended culture was loaded onto either: 1) a Novex® NuPAGE® 12% Bis-Tris gel (Life Technologies), or 2) a Novex®16% Tricine gel (Life Technologies), and run using standard manufacturer's protocols. Gels were stained using SimplyBlue™ SafeStain (Life Technologies) using the standard manufacturer's protocol and imaged using the Molecular Imager® Gel Doc™ XR+System (Bio-Rad). Over-expressed heterologous protein was identified by comparison against a molecular weight marker and control cultures.

Using this method, recombinant expression of the proteins listed in Tables 8A and 8B was observed.

TABLE 8A

| Seq ID No | UniProt | FragEnds | EAA | BCAA | L | C |
|---|---|---|---|---|---|---|
| 2519 | P15989 | 388:487 | 0.52 | 0.36 | 0.15 | 0 |
| 2520 | P15989 | 341:442 | 0.48 | 0.36 | 0.16 | 0 |
| 2521 | — | — | 0.50 | 0.41 | 0.16 | 1 |
| 2522 | P10587 | 1287:1386 | 0.49 | 0.26 | 0.17 | 0 |
| 2523 | Q27991 | 1353:1452 | 0.46 | 0.23 | 0.17 | 0 |
| 2524 | — | — | 0.64 | 0.33 | 0.21 | 0 |
| 2525 | P15989 | 398:447 | 0.57 | 0.41 | 0.18 | 0 |
| 2526 | P02662 | 2:51 | 0.59 | 0.31 | 0.18 | 1 |
| 2527 | P02662 | 3:52 | 0.59 | 0.33 | 0.18 | 1 |
| 2528 | P02662 | 4:53 | 0.57 | 0.31 | 0.16 | 1 |
| 2529 | P02662 | 5:54 | 0.55 | 0.29 | 0.14 | 1 |
| 2530 | P02662 | 6:55 | 0.55 | 0.29 | 0.16 | 1 |
| 2531 | P02662 | 79:128 | 0.41 | 0.28 | 0.12 | 0 |
| 2532 | P02662 | 86:135 | 0.41 | 0.27 | 0.13 | 0 |
| 2533 | Q9FRT9 | 1:90 | 0.32 | 0.11 | 0.07 | 10 |
| 2534 | P09643 | 1:322 | 0.44 | 0.20 | 0.08 | 10 |
| 2535 | Q9HD67 | 472:521 | 0.49 | 0.29 | 0.20 | 1 |
| 2536 | Q02440 | 461:511 | 0.50 | 0.23 | 0.13 | 1 |
| 2537 | Q13402 | 452:509 | 0.52 | 0.24 | 0.11 | 1 |
| 2538 | Q02440 | 413:512 | 0.52 | 0.22 | 0.09 | 2 |
| 2539 | Q28970 | 427:527 | 0.51 | 0.21 | 0.10 | 1 |
| 2540 | Q90584 | 436:486 | 0.60 | 0.41 | 0.32 | 0 |
| 2541 | P22281 | 82:134 | 0.58 | 0.46 | 0.24 | 1 |
| 2542 | Q17R14 | 270:321 | 0.64 | 0.39 | 0.20 | 0 |
| 2543 | Q27991 | 1396:1446 | 0.49 | 0.31 | 0.23 | 0 |
| 2544 | P12106 | 170:220 | 0.70 | 0.32 | 0.14 | 1 |
| 2545 | P32191 | 112:163 | 0.58 | 0.31 | 0.15 | 1 |
| 2546 | P19524 | 1398:1449 | 0.56 | 0.25 | 0.18 | 2 |
| 2547 | Q03262 | 225:277 | 0.65 | 0.30 | 0.13 | 1 |
| 2548 | P12863 | 82:132 | 0.51 | 0.33 | 0.17 | 1 |
| 2549 | P12106 | 159:209 | 0.67 | 0.29 | 0.14 | 1 |
| 2550 | A6QR56 | 589:691 | 0.47 | 0.34 | 0.21 | 2 |
| 2551 | P32492 | 1218:1319 | 0.67 | 0.25 | 0.14 | 1 |
| 2552 | P79114 | 688:788 | 0.48 | 0.26 | 0.15 | 2 |
| 2553 | Q5MIB5 | 492:592 | 0.53 | 0.27 | 0.14 | 2 |

TABLE 8A-continued

| Seq ID No | UniProt | FragEnds | EAA | BCAA | L | C |
|---|---|---|---|---|---|---|
| 2554 | P04119 | 28:129 | 0.51 | 0.26 | 0.17 | 2 |
| 2555 | P06642 | 14:115 | 0.55 | 0.27 | 0.14 | 2 |
| 2556 | Q2XQV4 | 108:213 | 0.49 | 0.26 | 0.15 | 2 |
| 2557 | P32492 | 1086:1287 | 0.58 | 0.29 | 0.15 | 1 |
| 2558 | Q76FS2 | 59:260 | 0.46 | 0.23 | 0.12 | 7 |
| 2559 | Q36967 | 1:105 | 0.65 | 0.46 | 0.26 | 0 |
| 2560 | Q31721 | 1:58 | 0.63 | 0.38 | 0.19 | 2 |
| 2561 | Q5ZMN0 | 44:93 | 0.53 | 0.36 | 0.26 | 0 |
| 2562 | Q5ZMN0 | 46:95 | 0.54 | 0.36 | 0.26 | 0 |
| 2563 | Q5ZMN0 | 47:96 | 0.52 | 0.36 | 0.26 | 0 |
| 2564 | Q5ZMN0 | 1:146 | 0.53 | 0.30 | 0.21 | 2 |
| 2565 | Q5ZMN0 | 1:147 | 0.52 | 0.30 | 0.21 | 2 |
| 2566 | Q5ZMN0 | 1:148 | 0.53 | 0.30 | 0.21 | 2 |
| 2567 | Q5ZMN0 | 1:149 | 0.52 | 0.29 | 0.21 | 2 |
| 2568 | Q5ZMN0 | 1:150 | 0.52 | 0.29 | 0.21 | 2 |
| 2569 | Q5ZMN0 | 1:151 | 0.52 | 0.29 | 0.20 | 2 |
| 2570 | Q5ZMN0 | 1:152 | 0.51 | 0.29 | 0.20 | 2 |
| 2571 | Q5ZMN0 | 1:153 | 0.51 | 0.29 | 0.20 | 2 |
| 2572 | Q5ZMN0 | 1:154 | 0.51 | 0.28 | 0.20 | 2 |
| 2573 | Q5ZMN0 | 1:161 | 0.49 | 0.27 | 0.19 | 2 |
| 2574 | Q9JLT0 | 127:231 | 0.48 | 0.21 | 0.15 | 0 |
| 2575 | Q27991 | 141:190 | 0.51 | 0.28 | 0.23 | 0 |
| 2576 | Q27991 | 136:185 | 0.51 | 0.28 | 0.21 | 0 |
| 2577 | Q27991 | 116:185 | 0.51 | 0.27 | 0.21 | 0 |
| 2578 | Q27991 | 146:200 | 0.51 | 0.29 | 0.21 | 0 |
| 2579 | Q27991 | 146:210 | 0.52 | 0.27 | 0.20 | 0 |
| 2580 | Q27991 | 136:190 | 0.50 | 0.27 | 0.21 | 0 |
| 2581 | Q27991 | 146:195 | 0.50 | 0.30 | 0.21 | 0 |
| 2582 | Q27991 | 126:190 | 0.52 | 0.26 | 0.19 | 0 |
| 2583 | Q27991 | 141:200 | 0.51 | 0.28 | 0.21 | 0 |
| 2584 | Q27991 | 161:210 | 0.50 | 0.24 | 0.19 | 0 |
| 2585 | Q27991 | 126:185 | 0.53 | 0.27 | 0.19 | 0 |
| 2586 | Q27991 | 111:210 | 0.50 | 0.26 | 0.19 | 0 |
| 2587 | Q27991 | 116:215 | 0.50 | 0.26 | 0.18 | 0 |
| 2588 | Q27991 | 126:225 | 0.46 | 0.22 | 0.15 | 0 |
| 2589 | Q27991 | 126:237 | 0.45 | 0.21 | 0.15 | 0 |
| 2590 | Q9JLT0 | 194:244 | 0.45 | 0.20 | 0.14 | 0 |
| 2591 | Q61879 | 154:252 | 0.41 | 0.19 | 0.14 | 0 |
| 2592 | P15989 | 99:208 | 0.52 | 0.37 | 0.17 | 0 |
| 2593 | P15989 | 99:203 | 0.51 | 0.37 | 0.16 | 0 |
| 2594 | P15989 | 49:166 | 0.44 | 0.28 | 0.15 | 0 |
| 2595 | Q90339 | 201:265 | 0.45 | 0.21 | 0.18 | 0 |
| 2596 | Q9BE41 | 216:265 | 0.48 | 0.21 | 0.18 | 0 |
| 2597 | Q9TV62 | 241:290 | 0.48 | 0.17 | 0.15 | 0 |
| 2598 | Q5SX39 | 236:285 | 0.45 | 0.19 | 0.17 | 0 |
| 2599 | Q9TV61 | 151:265 | 0.52 | 0.21 | 0.16 | 0 |
| 2600 | Q27991 | 20:289 | 0.38 | 0.20 | 0.15 | 0 |
| 2601 | Q0WVK7 | 53:105 | 0.57 | 0.27 | 0.12 | 2 |
| 2602 | Q94A52 | 149:261 | 0.54 | 0.26 | 0.12 | 2 |
| 2603 | P38111 | 1093:1165 | 0.59 | 0.30 | 0.13 | 3 |
| 2604 | P38111 | 1093:1182 | 0.57 | 0.27 | 0.13 | 3 |
| 2605 | P38111 | 1093:1162 | 0.57 | 0.27 | 0.13 | 3 |
| 2606 | P38111 | 1092:1166 | 0.59 | 0.29 | 0.13 | 3 |
| 2607 | P38111 | 1093:1168 | 0.58 | 0.29 | 0.13 | 3 |
| 2608 | P38111 | 1091:1164 | 0.59 | 0.30 | 0.13 | 3 |
| 2609 | P38111 | 1089:1164 | 0.58 | 0.29 | 0.13 | 3 |

TABLE 8B

| Seq ID No | SolvScore | AggScore | Allergenicity | Toxicity | Antinutricity | Human Homology |
|---|---|---|---|---|---|---|
| 2519 | −15.79 | 0.80 | 0.31 | 0.00 | 1.00 | 0.67 |
| 2520 | −16.50 | 0.84 | 0.29 | 0.00 | 1.00 | 0.62 |
| 2521 | −21.97 | 1.00 | 0.30 | 0.00 | 0.25 | 0.39 |
| 2522 | −28.44 | 0.16 | 0.36 | 0.00 | 0.00 | 0.84 |
| 2523 | −36.33 | 0.16 | 0.33 | 0.00 | 0.00 | 0.87 |
| 2524 | −27.36 | 0.49 | 0.34 | 0.00 | 0.30 | 0.41 |
| 2525 | −17.59 | 0.99 | 0.20 | 0.00 | 1.00 | 0.64 |
| 2526 | −17.98 | 0.90 | 0.63 | 0.00 | 0.00 | 0.44 |
| 2527 | −16.59 | 0.95 | 0.63 | 0.00 | 0.32 | 0.44 |
| 2528 | −16.79 | 0.87 | 0.63 | 0.00 | 0.33 | 0.44 |
| 2529 | −18.37 | 0.77 | 0.63 | 0.00 | 0.30 | 0.42 |
| 2530 | −18.37 | 0.71 | 0.63 | 0.00 | 0.32 | 0.40 |
| 2531 | −24.84 | 0.25 | 0.63 | 0.26 | 0.00 | 0.35 |
| 2532 | −26.10 | 0.22 | 0.63 | 0.26 | 0.00 | 0.33 |
| 2533 | −15.45 | 0.39 | 0.32 | 1.00 | 0.34 | 0.34 |
| 2534 | −19.21 | 0.44 | 0.99 | 0.00 | 0.00 | 0.96 |
| 2535 | −25.30 | 0.46 | 0.22 | 0.33 | 0.34 | 1.00 |
| 2536 | −22.49 | 0.43 | 0.21 | 0.31 | 0.35 | 0.94 |
| 2537 | −22.06 | 0.51 | 0.21 | 0.28 | 0.27 | 1.00 |
| 2538 | −21.01 | 0.41 | 0.31 | 0.00 | 0.28 | 0.94 |
| 2539 | −23.16 | 0.43 | 0.28 | 0.00 | 0.00 | 0.98 |
| 2540 | −15.02 | 1.17 | 0.22 | 0.34 | 0.35 | 0.75 |
| 2541 | −10.60 | 1.38 | 0.22 | 0.00 | 0.34 | 0.28 |
| 2542 | −18.91 | 0.89 | 0.20 | 0.00 | 0.32 | 0.94 |
| 2543 | −31.57 | 0.29 | 0.21 | 0.00 | 0.31 | 0.88 |
| 2544 | −17.13 | 0.77 | 0.20 | 0.31 | 0.28 | 0.61 |
| 2545 | −16.98 | 0.76 | 0.19 | 0.25 | 0.17 | 0.52 |
| 2546 | −20.09 | 0.24 | 0.21 | 0.29 | 0.30 | 0.43 |
| 2547 | −19.93 | 0.52 | 0.22 | 0.32 | 0.32 | 0.33 |
| 2548 | −16.57 | 0.79 | 0.58 | 0.33 | 0.24 | 0.59 |
| 2549 | −16.05 | 0.65 | 0.20 | 0.28 | 0.31 | 0.65 |
| 2550 | −17.15 | 0.83 | 0.30 | 0.30 | 0.00 | 0.84 |
| 2551 | −21.64 | 0.55 | 0.26 | 0.26 | 0.26 | 0.00 |
| 2552 | −24.45 | 0.54 | 0.32 | 0.24 | 0.25 | 0.91 |
| 2553 | −23.71 | 0.37 | 0.30 | 0.27 | 0.29 | 0.93 |
| 2554 | −22.23 | 0.52 | 0.74 | 0.00 | 0.19 | 0.44 |
| 2555 | −18.41 | 0.58 | 0.29 | 0.29 | 0.25 | 0.78 |
| 2556 | −17.59 | 0.58 | 0.60 | 0.00 | 0.23 | 0.98 |
| 2557 | −19.98 | 0.57 | 0.31 | 0.00 | 0.24 | 0.00 |
| 2558 | −17.02 | 0.48 | 0.53 | 0.00 | 0.22 | 0.88 |
| 2559 | −5.92 | 1.63 | 0.30 | 0.00 | 0.27 | 0.61 |

TABLE 8B-continued

| Seq ID No | SolvScore | AggScore | Allergenicity | Toxicity | Antinutricity | Human Homology |
|---|---|---|---|---|---|---|
| 2560 | −6.10 | 1.53 | 0.21 | 0.00 | 0.26 | 0.40 |
| 2561 | −18.69 | 0.54 | 0.18 | 0.24 | 0.35 | 0.84 |
| 2562 | −17.31 | 0.54 | 0.20 | 0.24 | 0.33 | 0.84 |
| 2563 | −17.40 | 0.47 | 0.20 | 0.22 | 0.34 | 0.84 |
| 2564 | −22.65 | 0.39 | 0.32 | 0.25 | 0.25 | 0.76 |
| 2565 | −22.50 | 0.39 | 0.32 | 0.25 | 0.25 | 0.76 |
| 2566 | −22.35 | 0.39 | 0.32 | 0.25 | 0.26 | 0.76 |
| 2567 | −22.74 | 0.39 | 0.32 | 0.00 | 0.25 | 0.76 |
| 2568 | −22.59 | 0.39 | 0.32 | 0.00 | 0.25 | 0.75 |
| 2569 | −22.97 | 0.38 | 0.32 | 0.24 | 0.25 | 0.76 |
| 2570 | −23.34 | 0.38 | 0.32 | 0.24 | 0.25 | 0.75 |
| 2571 | −23.25 | 0.38 | 0.32 | 0.24 | 0.25 | 0.75 |
| 2572 | −23.61 | 0.37 | 0.32 | 0.00 | 0.25 | 0.75 |
| 2573 | −24.11 | 0.36 | 0.32 | 0.23 | 0.26 | 0.75 |
| 2574 | −33.59 | 0.15 | 0.34 | 0.25 | 0.00 | 1.00 |
| 2575 | −36.26 | 0.21 | 0.21 | 0.29 | 0.33 | 0.92 |
| 2576 | −34.27 | 0.27 | 0.22 | 0.25 | 0.00 | 0.90 |
| 2577 | −32.73 | 0.22 | 0.25 | 0.31 | 0.00 | 0.87 |
| 2578 | −34.50 | 0.23 | 0.21 | 0.00 | 0.00 | 0.89 |
| 2579 | −34.08 | 0.25 | 0.26 | 0.00 | 0.00 | 0.91 |
| 2580 | −34.67 | 0.22 | 0.23 | 0.25 | 0.00 | 0.91 |
| 2581 | −33.39 | 0.29 | 0.20 | 0.00 | 0.31 | 0.88 |
| 2582 | −37.57 | 0.19 | 0.25 | 0.31 | 0.00 | 0.92 |
| 2583 | −35.42 | 0.21 | 0.24 | 0.21 | 0.00 | 0.90 |
| 2584 | −33.68 | 0.26 | 0.23 | 0.00 | 0.00 | 0.92 |
| 2585 | −37.47 | 0.23 | 0.25 | 0.00 | 0.00 | 0.92 |
| 2586 | −33.38 | 0.20 | 0.31 | 0.00 | 0.00 | 0.87 |
| 2587 | −32.78 | 0.18 | 0.33 | 0.27 | 0.29 | 0.88 |
| 2588 | −36.89 | 0.16 | 0.35 | 0.00 | 0.00 | 0.92 |
| 2589 | −37.66 | 0.15 | 0.39 | 0.00 | 0.00 | 0.93 |
| 2590 | −29.21 | 0.16 | 0.25 | 0.00 | 0.27 | 1.00 |
| 2591 | −30.24 | 0.12 | 0.33 | 0.00 | 0.00 | 0.99 |
| 2592 | −16.02 | 0.94 | 0.32 | 0.00 | 1.00 | 0.63 |
| 2593 | −16.69 | 0.94 | 0.30 | 0.00 | 1.00 | 0.63 |
| 2594 | −17.69 | 0.65 | 0.31 | 0.00 | 1.00 | 0.62 |
| 2595 | −34.37 | 0.07 | 0.29 | 0.00 | 0.00 | 0.98 |
| 2596 | −38.56 | 0.08 | 0.24 | 0.00 | 0.00 | 0.98 |
| 2597 | −41.59 | 0.04 | 0.26 | 0.00 | 0.00 | 0.98 |
| 2598 | −40.29 | 0.04 | 0.23 | 0.28 | 0.00 | 0.98 |
| 2599 | −35.70 | 0.11 | 0.36 | 0.26 | 0.22 | 0.99 |
| 2600 | −34.97 | 0.13 | 0.40 | 0.23 | 0.22 | 0.93 |
| 2601 | −26.91 | 0.45 | 0.18 | 0.30 | 0.22 | 0.31 |
| 2602 | −25.52 | 0.46 | 0.29 | 0.00 | 0.25 | 0.81 |
| 2603 | −23.00 | 0.80 | 0.27 | 0.00 | 0.24 | 0.26 |
| 2604 | −20.82 | 0.80 | 0.27 | 0.00 | 0.25 | 0.27 |
| 2605 | −23.98 | 0.70 | 0.25 | 0.27 | 0.25 | 0.27 |
| 2606 | −22.45 | 0.79 | 0.27 | 0.27 | 0.25 | 0.25 |
| 2607 | −22.10 | 0.80 | 0.27 | 0.28 | 0.24 | 0.25 |
| 2608 | −22.75 | 0.77 | 0.28 | 0.31 | 0.25 | 0.25 |
| 2609 | −23.28 | 0.71 | 0.28 | 0.28 | 0.25 | 0.24 |

Example 7

Scaled Up Production of Recombinant Nutritive Proteins

A representative protocol for producing quantities of nutritive proteins as described in this disclosure is as follows 5 ml LB with 100 mg/l carbenicillin (in a 50 ml baffled Pyrex shake flask) is inoculated with a stab from the glycerol stock of a recombinant *E. coli* strain comprising a recombinant gene encoding a nutritive protein and grown until late exponential phase (OD600 nm≈2) at 37° C. and 250 rpm. A 2.5l Ultra Yield Flask (Thomson Instrument Company) is inoculated with 500 ml sterile water and enough EnBase EnPresso™ tablets (BioSilta) to formulate 500 ml growth medium. This medium is supplemented with 100 mg/l carbenicillin, 0.001% Industrol 204 antifoam, and 0.6 U/l EnzI'm (BioSilta). The shake flask is inoculated to OD600 nm≈0.05 and grown 16 hr at 30° C. and 250 rpm. At this point, OD600 nm≈10 had been reached, the growth medium is further supplemented with EnPresso™ Booster tablets (BioSilta), 1.2 U/l EnzI'm, and 1 mM IPTG to induce heterologous protein production. After another 8-24 hr of shaking at 30° C. and 250 rpm, the flask is harvested by centrifugation at 10,000 rpm, the supernatant is decanted, and the wet cell weight is measured. At this point, approximately 20 gWCW (grams wet cell weight)/l medium is recovered.

The harvested cells from each shake-flask fermentation are suspended in 25 mL of IMAC Equilibration Solution (30 mM Imidazole, 50 mM Phosphate, 0.5 M NaCl, pH 7.5). The suspended cells are then lysed by sonication at 90 Watts for 90 seconds, on ice. The lysed cells are centrifuged at 15,500 RCF for 60 minutes, and decanted. The cell debris is discarded, and the supernatants are 0.2 m filtered. Filters are then flushed with an additional 10 mL of IMAC Equilibration Solution. These filtered protein solutions are then purified by immobilized metal affinity chromatography (IMAC).

IMAC resin (GE Healthcare, IMAC Sepharose 6 Fast Flow) is charged with nickel and equilibrated. 30 mL of each protein solution is loaded onto a 5 mL IMAC column, and washed with additional equilibration solution to remove unbound impurities. The protein of interest is then eluted with 15 mL of 0.5 M NaCl, 0.2 M Imidazole, pH 7.5. The purified proteins are shown to be 90% pure, by SDS-PAGE. Approximately 20 to 60 mg of each protein is recovered in the IMAC elution fractions. Each IMAC elution fraction is buffer exchanged by dialysis into a formulation solution (20 mM HEPES, pH 7.5). After buffer exchange, these protein solutions are recovered for all downstream processing.

Example 8

Prediction of Soluble Expression of Nutritive Proteins

Open reading frames encoding a set of 292 nutritive proteins were cloned and introduced into *E. coli* to assess recombinant protein expression using the method of Example 6. In the system used, 163 proteins were identified as expressed while 129 were not. Of the 163 proteins that expressed, 125 were tested for soluble expression. It was found that 75 were solubly expressed while 50 were not.

FIG. 1 shows a two dimensional histogram of protein expression in the *E. coli* expression screen. FIG. 1 shows the relative likelihood (on a log scale) of a protein being expressed as a function of solvation score (y-axis) and aggregation score (x-axis). A darker mark on the histogram indicates a higher number of proteins expressed, while a lighter mark indicates a fewer number of proteins expressed. FIG. 1 shows that those proteins that were successfully expressed tend to cluster in the top left region of the plot, where the solvation score is more negative ($\leq -20$) and the aggregation score is smaller ($\leq 0.75$). There were few examples of proteins that were successfully expressed with less negative solvation scores ($\geq -15$) and large aggregation scores ($\geq 1$). This result suggests that nutritive proteins with solvation scores of $-20$ or less and aggregation scores of 0.75 or less are more likely to be expressed in this system.

Figure 2:
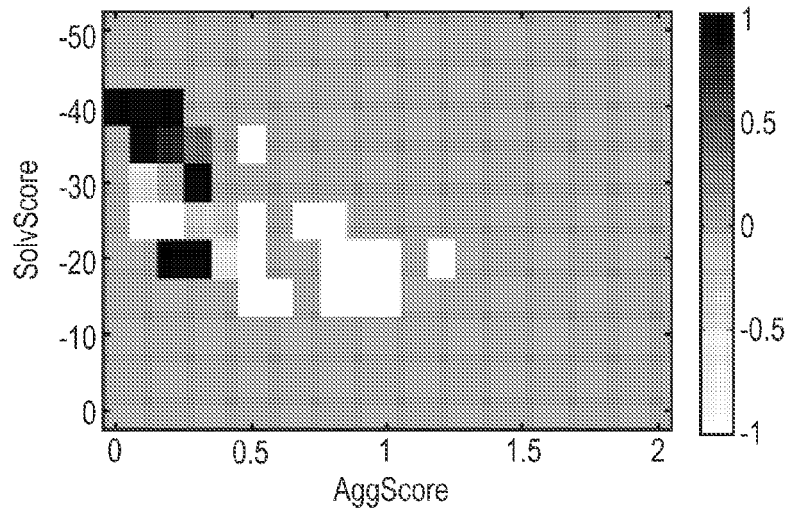
FIG. 2 shows a two dimensional histogram indicating the relative likelihood (on a log scale) of a protein being solubly expressed in an *E. coli* expression screen as a function of solvation score (y-axis) and aggregation score (x-axisNN

FIG. 2 shows a two dimensional histogram of the number of soluble protein expression in the *E. coli* expression screen. FIG. 2 shows the relative likelihood (on a log scale) of a protein being solubly expressed as a function of solvation score (y-axis) and aggregation score (x-axis). Again, a darker mark on the histogram indicates a higher number of proteins expressed, while a lighter mark indicates a fewer number of proteins expressed. FIG. 1 shows that those proteins that were expressed solubly tended to cluster in the top left region of the plot, where the solvation score is more negative ($\leq -20$) and the aggregation score is smaller ($\leq 0.5$). There were few examples of proteins that were expressed solubly with less negative solvation scores ($\geq -15$) and large aggregation scores ($\geq 0.75$). This result suggests that nutritive proteins with solvation scores of $-20$ or less and aggregation scores of 0.5 or less are more likely to be solubly expressed in this system.

Example 9

Solubility Screening

The solubility of nine nutritive proteins produced as described Examples 6 and 7 was examined by centrifuge concentration followed by protein concentration assays. Samples in 20 mM HEPES pH 7.5 were tested for protein concentration according to the protocol for Coomassie Plus (Bradford) Protein Assay (Thermo Scientific) and absorbance at 280 nm (if applicable). Based on these measurements 10 mg of protein was added to an Amicon Ultra 3 kDa centrifugal filter (Millipore). Samples were concentrated by centrifugation at 10,000×g for 30 minutes. The final concentrated samples were examined for precipitated protein and color, and then tested for protein concentration as described above. The results are shown in Table 9.

TABLE 9

| Seq ID No | Appearance | Concentration (g/L) |
| --- | --- | --- |
| 2580 | Clear Faint Yellow | 44 |
| 2582 | Clear Faint Yellow | 166 |
| 2587 | Clear Colorless | 107 |
| 2595 | Clear Colorless | 60 |
| 2596 | Clear Colorless | 29 |
| 2598 | Clear Colorless | 151 |
| 2599 | Clear Colorless | 207 |
| 2600 | Clear Yellow | 95 |
| 2603 | Clear Yellow | 191 |

The solubilities of these nutritive proteins were found to be significantly higher than concentrations typically found for whey (12.5 g/L) and soy (10 g/L) (Pelegrine, D. H. G. & Gasparetto, C. A., 2005. Whey proteins solubility as function of temperature and pH. LWT—Food Science and Technology, p. 77-80; Lee, K. H., Ryu, H. S. & and Rhee, K. C., 2003. Protein solubility characteristics of commercial soy protein products. Journal of the American Oil Chemists' Society, pp. 85-90). This demonstrates the usefulness of the nutritive proteins disclosed herein. For example, the solubility of nutritive proteins may improve compliant delivery of high quality protein in as small of a volume as possible while avoiding the "chalkyness" that often characterizes proteins delivered in this manner. This may, for example, be useful to deliver proteins to the elderly or other subjects.

Example 10

Stability Screening

Thermal stability of nutritive proteins provides insight regarding whether the protein is likely to have a useful shelf life. Samples of proteins produced as described in Examples 6 and 7 were screened in parallel using a rapid thermal stability screening method. In this method proteins were heated slowly from 25° C. to 95° C. in two representative formulations in the presence of a hydrophobic dye (Enzo Life Sciences, ProteoStat® Thermal shift stability assay kit) that binds to aggregated proteins that form as the protein denatures with increasing temperature (Niesen, F. H., Berglund, H. & Vadadi, M., 2007. The use of differential scanning fluorimetry to detect ligand interactions that promote protein stability. Nature Protocols, Volume 2, pp. 2212-2221.). Upon binding, the dye's fluorescence increases significantly, which is then recorded by the rtPCR instrument and represented as the protein's melting curve (Lavinder, J. J., Hari, S. B., Suillivan, B. J. & Magilery, T. J., 2009. High-Throughput Thermal Scanning: A General, Rapid Dye-Binding Thermal Shift Screen for Protein Engineering. *Journal of the American Chemical Society*, pp. 3794-3795.). After the thermal shift is complete samples were examined for insoluble precipitates and further analyzed by analytical size exclusion chromatography (SEC).

Protein solutions (12.5 mg/ml) were prepared in both PBS and 20 mM HEPES pH 7.7 buffers, each containing 1× ProteoStat TS Detection Reagent. Samples of each solution were heated slowly from 25° C.-95° C., 0.5° C./30 seconds using a real-time PCR (rtPCR) thermocycler while monitoring the fluorescence of the dye. From this thermal scan the temperature of aggregation was determined ($T_{agg}$) from the temperature with the strongest slope if an increase in fluorescence was observed. To supplement the assay, samples were taken before and after the thermal shift and analyzed by SEC (GE Healthcare—Superdex 75 5/150) which can detect large soluble aggregates. The results for seven nutrive proteins of this disclosure and a whey standard are presented in Table 10. The presence of soluble aggregates detected by SEC is noted by a "yes" if observed or "no" if not observed, and the "n/a" entries for the whey standard indicate the production of insoluble precipitates such that no SEC analysis was performed.

TABLE 10

| Seq ID No | HEPES - $T_{agg}$ | PBS - $T_{agg}$ | HEPES - SEC Agg? | PBS - SEC Agg? |
|---|---|---|---|---|
| 2582 | 95 | 95 | No | No |
| 2587 | 95 | 95 | No | No |
| 2596 | 45 | 95 | No | No |
| 2598 | 95 | 95 | No | No |
| 2599 | 95 | 95 | No | No |
| 2600 | 95 | 95 | Yes | Yes |
| 2603 | 95 | 95 | Yes | Yes |
| whey | 79 | 81.5 | n/a | n/a |

As shown in Table 10, SEQ ID NOS: 2582, 2587, 2596, 2598, and 2599 had much higher HEPES $T_{agg}$ than whey (in fact, the proteins did not form any aggregates at 95° C., which was the upper limit of the assay), and thus are expected to be more stable than whey. The SEQ ID NOS: 2600 and 2603 proteins had higher HEPES $T_{agg}$ and PBS $T_{agg}$ values than whey, but both formed soluble aggregates in solution while whey formed insoluble aggregates that precipitated from solution. Thus, even in an aggregated state, these two nutritive proteins would be expected to remain in solution for a greater period of time than whey.

Example 11

Digestibility Screening—Determination of Digestion Half-Life

The goal of screening for protein digestibility is to eliminate potentially unsafe allergenic proteins and to determine the relative completeness of digestion as a predictor of peptide bioavailability. This screening method utilizes a physiologically relevant in vitro digestion reaction that includes both phases of protein digestion, simulated gastric digestion and simulated intestinal digestion (Moreno, J. F. et al., 2005. Stability of the major allergen Brazil nut 2S albumin (Ber e 1) to physiologically relevant in vitro gastrointestinal digestion. FEBS Journal, pp. 341-352.). Samples can be taken throughout the reaction and analyzed for intact protein and peptide fragments using chip electrophoresis and LC-QTOF-MS. Proteins with allergenic properties can be assessed by identifying proteins or large fragments of proteins that are resistant to digestive proteases and thus have a higher risk of causing an allergenic reaction (Goodman, R. E. et al., 2008. Allergenicity assessment of genetically modified crops—what makes sense?. Nature Biotechnology, pp. 73-81.). Digestibility is measured by determining how efficiently the protein is broken down into peptides (Daniel, H., 2003. Molecular and Integrative Physiology of Intestinal Peptide Transport. Annual Review of Physiology, Volume 66, pp. 361-384.).

The method used an automated assay for in vitro digestions of proteins wherein assay conditions and protease concentrations are physiologically relevant (Moreno, F. J., Mackie, A. R. & Clare Mills, E. N., 2005. Phospholipid interactions protect the milk allergen a-Lactalbumin from proteolysis during in vitro digestion. Journal of agricultural and food chemistry, pp. 9810-9816; Martos, G., Contreras, P., Molina, E. & Lopez-Fandino, R., 2010. Egg White Ovalbumin Digestion Mimicking Physiological Conditions. Journal of Agricultural and food chemistry, pp. 5640-5648; Moreno, J. F. et al., 2005. Stability of the major allergen Brazil nut 2S albumin (Ber e 1) to physiologically relevant in vitro gastrointestinal digestion. FEBS Journal, pp. 341-352.). The first phase of digestion is in simulated gastric fluid (SGF) and formulated at pH 1.5 and with a pepsin:substrate ratio of (1:10 w/w). The second phase of digestion is in simulated intestinal fluid (SIF) is formulated with bile salts at pH 6.5 and with an trypsin:chymotrypsin:substrate ratio of (1:4:400 w/w). The protein is treated for 120 mins in the simulated gastric fluid, which is how long it takes for 90% of a liquid meal to pass from the stomach to the small intestine (Kong, F. & Singh, R. P., 2008. Disintegration of Solid Foods in Human Stomach. Journal of Food Science, pp. 67-80), and then treated with simulated intestinal fluid for 120 mins. Sample time points are taken throughout both reactions and quenched for analysis. Bovine serum albumin, which is readily digested by pepsin, is the positive control for the SGF solution, and beta-lactoglobulin, which is naturally resistant to pepsin but digested in SIF, is the positive control for SIF solution. Intact protein and large fragments were detected using electrophoresis. For chip electrophoresis, a Caliper Labchip GXII equipped with a HT Low MW Protein Assay Kit was used to monitor the size and amount of intact protein as well as any digestion fragments larger than 4 kDa. By monitoring the amount of intact protein observed over time, the half-life ($\tau_{1/2}$) of digestion was calculated for SGF and, if intact protein is detected after SGF digestion, in SIF.

This method was used to analyze the digestion half-lives of thirteen nutritive proteins of this disclosure (SEQ ID NOS: 2547, 2575, 2578, 2580, 2582, 2587, 2595, 2596, 2598, 2599, 2600, 2602, and 2603) produced as described in Examples 6 and 7, as well as native and recombinant ovalbumin (OVA and rOVA, respectively; SEQ ID NO: 2610) and beta-lactoglobulin (BLG and rBLG, respectively; SEQ ID NO: 2611) proteins and a whey standard. The results of these experiments are summarized in Table 11. An "n/a" entry in the Simulated Intestinal Fluid field indicates that no intact protein was detected after SGF digestion.

TABLE 11

| | Digestion $\tau_{1/2}$ (min.) | |
|---|---|---|
| Seq ID No. | Simulated Gastric Fluid | Simulated Intestinal Fluid |
| 2547 | 0.3 | n/a |
| 2575 | 0.3 | n/a |
| 2578 | 2 | n/a |
| 2580 | 6 | n/a |
| 2582 | 0.5 | n/a |
| 2587 | 0.7 | n/a |
| 2595 | 10 | n/a |
| 2596 | 0.6 | n/a |
| 2598 | 0.7 | n/a |
| 2599 | 0.3 | n/a |
| 2600 | 29 | 1 |
| 2602 | 1 | n/a |
| 2603 | 6 | n/a |

TABLE 11-continued

| Seq ID No. | Digestion $\tau_{1/2}$ (min.) | |
|---|---|---|
| | Simulated Gastric Fluid | Simulated Intestinal Fluid |
| BLG (2611) | 77 | 4 |
| rBLG (2611) | 50 | 0.7 |
| OVA (2610) | 18 | 1 |
| rOVA (2610) | 5 | n/a |
| whey | 99 | 4 |

The results shown in Table 11 indicate that twelve of the thirteen nutritive proteins of this disclosure were all completely digested by SGF and have SGF half lives of ten minutes or less. By comparison whey is not completely digested by SGF and has an SGF half life of 99 minutes and a SIF half life of 4 minutes. This study suggests that the nutritive proteins of this disclosure are likely to be readily digested and not likely to elicit an allergic response when ingested.

The results in Table 11 also show that the recombinant beta-lactoglobulin and ovalbumin produced according to this disclosure were both more readily digested than their naturally-occurring counterparts. The speed in which a protein is broken down can be controlled by selecting for properties that improve or limit accessibility of the gastrointestinal proteases. This capability can be demonstrated for two typical protein properties, glycosylation and disulfide cross-linking. Like many naturally occurring proteins, naturally occurring OVA and BLG are glycosylated by their host organisms. In contrast, the recombinant proteins produced according to the present disclosure are not glycosylated because the host organism (*E. coli* in this case) does not glycosylate. The lack of glycolsylation in recombinant nutritive proteins according to this disclosure may result in proteins that are more readily digested. Furthermore, BLG has four disulfide bonds that are known to slow down or interfere with digestion. When these disulfide bonds are disrupted, the rate of digestion increases (Reddy, I. M., Kella, N. K. D. & Kinsella, J. E., 1988. Structural and conformational Basis of the Resistance of b-Lactoglobulin to Peptic and Chymotryptic Digestion. *J. Agric. Food Chem.*, Volume 36, pp. 737-741). A lack or disruption of disulfide bond formation in recombinant nutritive proteins according to this disclosure may result in proteins that are more readily digested.

Example 12

Digestibility Screening—Analysis of Digestion Products

Two nutritive proteins produced as described in Examples 6 and 7 (SEQ ID NOS: 2612 and 2613) were subjected to SGF and SIF digestion as described in Example 11. Both proteins were completely digested in SGF, and the SGF half lives are shown in Table 12.

TABLE 12

| Seq ID No | Digestion $\tau_{1/2}$ (min.) | |
|---|---|---|
| | Simulated Gastric Fluid | Simulated Intestinal Fluid |
| 2612 | 0.7 | n/a |
| 2613 | 6 | n/a |

To detect and identify peptides that were present after SGF and SIF digestion, samples of the SGF and SIF digests were analyzed by LC/Q-TOF MS/MS. Samples from the SGF digests were directly analyzed by LC/Q-TOF MS/MS, while SIF protein digestions required purification by SCX to remove bile acids before detection and identification by LC/Q-TOF MS/MS. Peptides were extracted from the chromatograms and identified using Bioconfirm Software (Aglient). The sequence assignment of peptides were based on accurate mass match (±10 ppm) and further confirmed by MS/MS fragmentation. The results are shown in Tables 13 and 14 below.

TABLE 13

(SEQ ID NO: 2612)

| SCF Peptides 120 min | SEQ ID NO | SIF Peptides 120 min | SEQ ID NO |
|---|---|---|---|
| LL | | SE | |
| LAL | | PSE | |
| HVL | | HVL | |
| LEL | | FKV | |
| LALA | 2616 | HQI | |
| LLLD | 2617 | PSEA | 2618 |
| IAEF | 2619 | REV | |
| IQQF | 2620 | FDK | |
| YDKL | 2621 | AEFK | 2622 |
| SNLTE | 2623 | LKHV | 2624 |
| ELLEA | 2625 | SSSEL | 2626 |
| EELAL | 2627 | FKVF | 2628 |
| DDLLL | 2629 | AELKH | 2630 |
| LAYDK | 2631 | LKHVL | 2632 |
| TKTRL | 2633 | FKEAF | 2634 |
| DLDHQ | 2635 | NGSISSS | 2636 |
| GTLENL | 2637 | SLGLSPS | 2638 |
| EKLTDA | 2639 | GEKLTD | 2640 |
| AEVDDM | 2641 | ELATVM | 2642 |
| LDDLLL | 2643 | GSGEINI | 2644 |
| LDLDHQ | 2645 | RSLGLSP | 2646 |
| DLKKKL | 2647 | ELKHVL | 2648 |
| KTKTRL | 2649 | KLTDAEV | 2650 |
| SQRLEE | 2651 | FKVFDK | 2652 |
| AEVDDML | 2653 | AEVDDML | 2654 |
| QQELDDL | 2655 | DAEVDDM | 2656 |
| LEKTKTR | 2657 | AELKHVL | 2658 |
| LEKTKTR | 2659 | HVLTSIGE | 2660 |
| GTLENLEE | 2661 | SIGEKLTD | 2662 |

TABLE 13-continued (SEQ ID NO: 2612)

| SCF Peptides 120 min | SEQ ID NO | SIF Peptides 120 min | SEQ ID NO |
|---|---|---|---|
| QQELDDLL | 2663 | RSLGLSPSE | 2664 |
| KLEKTKTRLQ | 2665 | VLTSIGEKL | 2666 |
| SRQLKSNDSEQ | 2667 | TSIGEKLTD | 2668 |
| EKTKTRLQQEL | 2669 | HVLTSIGEK | 2670 |
| YDKLEKTKTRL | 2671 | AELKHVLTS | 2672 |
| LAYDKLEKTKTRL | 2673 | RSLGLSPSEA | 2674 |
| EELKKKLLKDLEL | 2675 | SSNLTEEQIA | 2676 |
| EELKKKLLKDLELL | 2677 | RSLGLSPSEAE | 2678 |
| AELKHVLTSIGEKLTD | 2679 | KVFDKNGDGLISA | 2680 |
| MGSHHHHHHHSSNL | 2681 | FDKDNNGSISSSEL | 2682 |
| LREVSDGSGEINIQQF | 2683 | REVSDGSGEINIQQ | 2684 |
| AAELKHVLTSIGEKLTD | 2685 | DVDGNHQIEFSEF | 2686 |
| AELKHVLTSIGEKLTDAE | 2687 | LREVSDGSGEINIQQ | 2688 |
| AYDKLEKTKTRLQQEL | 2689 | REVSDGSGEINIQQF | 2690 |
| AAELKHVLTSIGEKLTDAE | 2691 | LREVSDGSGEINIQQFAALLS | 2692 |
| LENLEELKKKLLKDLEL | 2693 | | |
| KLEKTKTRLQQELDDLL | 2694 | | |
| DKLEKTKTRLQQELDDLL | 2695 | | |
| LAYDKLEKTKTRLQQELDDL | 2696 | | |
| LALAYDKLEKTKTRLQQELDDL | 2697 | | |

TABLE 14

(SEQ ID NO: 2613)

| SGF Peptides 120 min | SEQ ID NO | SIF Peptides 120 min | SEQ ID NO |
|---|---|---|---|
| GVL | | TKH | |
| ALL | | INDI | 2698 |
| LVL | | HLVL | 2699 |
| IGVL | 2700 | TIKF | 2701 |
| TIKF | 2702 | IGVLD | 2703 |
| TIKF | 2704 | RNLD | 2705 |
| EVYDL | 2706 | IGVLDV | 2707 |
| LNDSVQ | 2708 | QTIKF | 2709 |
| IWVIND | 2710 | VQTIKF | 2711 |
| DLNDSVQ | 2712 | SVQTIKF | 2713 |
| SVQTIKF | 2714 | KCAKCISMIGVL | 2715 |
| HHLVLGALLD | 2716 | EKCAKCISMIGV | 2717 |
| HHHHHHLVL | 2718 | HEFKRTTYSE | 2719 |
| HHHHHHHLVL | 2720 | SHKFRNLDKDL | 2721 |
| DVTKHEFKRTTY | 2722 | ISMIGVLDVTKHE | 2723 |
| SHHHHHHHLVL | 2724 | | |
| TKHEFKRTTYSEN | 2725 | | |
| GSHHHHHHHLVLG | 2726 | | |
| MGSHHHHHHHLVL | 2727 | | |
| KRTTYSENEVYDLN | 2728 | | |

As can been seen in Tables 13 and 14, each protein was digested into multiples smaller peptide fragments ranging in size from 2 to 22 amino acids (SEQ ID NO: 2612) or 2 to 13 amino acids (SEQ ID NO: 2613). None of these peptide fragments was found to be homologous to any known allergen.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (2728 sequences)

SEQ ID NO: 1 - protein, 201 aa, Sus scrofa
LFTNGKERLTLEFSEDCLYLNIYTPADLTKRGRLPVMVWIHGGGLVLGGAPMYDGVVLAAHENVVVVAIQYRLGIWGFFSTGDEHSRGNWGHLDQVAALHWVQENIANFGGDPGSVTIFGESAGGESVSVLVLSPLAKNLFHRAISESGVALTVALVRKDMKAAAKQIAVLAGCKTTTSAVFVHCLRQKSEDELLDLTLKM

SEQ ID NO: 2 - protein, 176 aa, Sus scrofa
MKWLVILGLVALSECLVIIPLTKVKSIRENLREKDLLLNFLKEHPYNMIQKFGLKGSLCSPKISCLRLWNYLDMVYVGNITIGTPPQLFSVIFDTASSDLWVPSNQCHSRACVTHRSFNPTLSSTFQSSNRTVKLAPHSGLVSGLLGYDTVQIGRFKSENQAFGLSQSEPVKELEN

SEQ ID NO: 3 - protein, 226 aa, Sus scrofa
WVQENIANFGGDPGSVTIFGESAGGESVSVLVLSPLAKNLFHRAISESGVALTVALVRKDMKAAAKQIAVLAGCKTTTSAVFVHCLRQKSEDELLDLTLKMKFLTLDFHGDQRESHPFLPTVVDGVLLPKMPEEILAEKDFNTVPYIVGINKQEFGWLLPTMMGFPLSEGKLDQKTATSLLWKSYPIANIPEELTPVATDKYLGGTDDPVKKKDLFLDLMGDVVFG

SEQ ID NO: 4 - protein, 76 aa, Sus scrofa
MKWLVILGLVALSECLVIIPLTKVKSIRENLREKDLLLNFLKEHPYNMIQKFGLKGSLCSPKISCLRLWNYLDMVY

SEQ ID NO: 5 - protein, 76 aa, Sus scrofa
MLNLLVLALPLLVSLVHTAPAPGQALERAGIVGGKEAPGHKWPWQVSLRCLDQYWKHFCGGSLIHPQWVLTAAHCF

SEQ ID NO: 6 - protein, 76 aa, Sus scrofa
MKWLVILGLVALSDCLVMIPLTKVKSVRESLREKGLLKNFLKEHPYNMIQNLLSKNSSHVQKFSYQPLRNYLDMVY

SEQ ID NO: 7 - protein, 76 aa, Sus scrofa
LFTNGKERLTLEFSEDCLYLNIYTPADLTKRGRLPVMVWIHGGGLVLGGAPMYDGVVLAAHENVVVVAIQYRLGIW

SEQ ID NO: 8 - protein, 126 aa, Sus scrofa
EWVSTRFRAIKSIAVGFFYTFGQFILPGLAYAIPQWRWLQLTVSVPFLTFFLLSWWLPESIRWMVLSGKSSKALKTLRQVAIFNGKKEEGEKLSLEELKLNLQKEISLAKARHGIADLFRTPVLRR

SEQ ID NO: 9 - protein, 226 aa, Sus scrofa
EWVSTRFRAIKSIAVGFFYTFGQFILPGLAYAIPQWRWLQLTVSVPFLTFFLLSWWLPESIRWMVLSGKSSKALKTLRQVAIFNGKKEEGEKLSLEELKLNLQKEISLAKARHGIADLFRTPVLRRVTLCLSLAWFATGFAYYSLAMGVEEFGVNLYVLQLIFGGVDVPAKFITMLSISYLGRHITEGIVLLLAGGCILALIFVPLDLMTLRTVLAVFGKGCLSGS

SEQ ID NO: 10 - protein, 226 aa, Sus scrofa
YNIVDRDSIVTEWDLVCSSSKLKEMAQSVFMAGILVGGLVLGALSDRFGRKPILIFSYLLLGASGSGAAFSPTFSIYAVFRFLCGFSISGISLSTAILNVEWVSTRFRAIKSIAVGFFYTFGQFILPGLAYAIPQWRWLQLTVSVPFLTFFLLSWWLPESIRWMVLSGKSSKALKTLRQVAIFNGKKEEGEKLSLEELKLNLQKEISLAKARHGIADLFRTPVLRR

SEQ ID NO: 11 - protein, 201 aa, Malus domestica
TALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISANSPVAKLRQLAGRHIPGEVVAVRVPLLHLSNFQINDWPELSTKRYALMVLMLPSDSARQWHVHELELVEVVAD

SEQ ID NO: 12 - protein, 101 aa, Prunus persica
TALMLVHIIPDLLSVKTRELFLKNKAAELDREMGLIRTQEETGRHVRMLTHEIRSTLDRHTILKTTLVELGRTLALEECALWMPTRTGLELQLSYTLRQQN

SEQ ID NO: 13 - protein, 101 aa, Malus domestica; identical to SEQ ID NO: 12

SEQ ID NO: 14 - protein, 201 aa, Prunus persica
TALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVAD

SEQ ID NO: 15 - protein, 76 aa, Sus scrofa
KAVVPEMEKRGGGSVLIVSSVGAYHPFPNLGPYNVSKTALLGLTKNLAVELAPRNIRVNCLAPGLIKTNFSQVLWM

SEQ ID NO: 16 - protein, 101 aa, Sus scrofa
LEKCLKYSLDVVSGLLFLHSQGIVHLDLKPANILISEQDVCKISDFGCSERLEDLRFRPRHHLGGTYTHRAPELLKGEPVTPKADIYSFAITLWQMTTRQV

SEQ ID NO: 17 - protein, 76 aa, Sus scrofa
TDVTFKTRKAIPYESGILGPLLYGEVGDTLLIIFKNKASRPYNIYPHGITDVSALHPGRLLKGWKHLKDMPILPGE

SEQ ID NO: 18 - protein, 101 aa, Sus scrofa
  MOD_RES (94)..(94): Any amino acid
  MOD_RES (99)..(99): Any amino acid
ELKLIGEYGLRNKREVWRVKFTLAKIRKAARELLTLDEKDPRRLFEGNALLRRLVRIGVLDEGKMKLDYILGLKIEDFLERRLQTQVFKLGLAXSIHHXRV

SEQ ID NO: 19 - protein, 151 aa, Sus scrofa
ELRAMMEKLVKSISQLKDQQDIFCFRYKIKASAKTHSLDPHRTRQEQVLQETLNELDKRRKEVLDASKALLGRLTTLIELLLPKLEEWKVQQQKACIGAPMDGELEQLEKWFTAEAKLLFHLRQLLKELKGLSSVVKYDEDLLFKGVDLLK

SEQ ID NO: 20 - protein, 76 aa, Sus scrofa
KKKFPFGYIKELKCRVLELPYQGKDLSMVILLPDSIEDESTGLRKIEQHLTLEKLNEWTKPDNLELLEVNVHLPRF

SEQ ID NO: 21 - protein, 101 aa, Sus scrofa
ALLLKPDIFFKIPWLYRKYEKSVKDLKEDMEILIEKKRRRIFTAEKLEDCMDFATELILAEKRGELTKENVNQCILEMLIAAPDTMSVTVFFMLFLIAKHP

SEQ ID NO: 22 - protein, 126 aa, Sus scrofa
LLLLLLLLPAPELGPREARAEETDWVRLPSKCEVCKYVAVELKSAFEETGKTKEVIDTGYGILDRKASGVKYTKSDLRLIEVTETICKRLLDYSLHKERTGSNRFAKGMSETFETLHNLVHKGVKV

SEQ ID NO: 23 - protein, 76 aa, Sus scrofa
SNLDSEVVWGKATQKEIEKQKFHLKSISEIGEALKMVLGKKETLVEDKLSLLNSNWIAVTSRAEEWLNLLLEYQKH

SEQ ID NO: 24 - protein, 76 aa, Sus scrofa
KKLSAQLMEHCQKLEEQIAKLRKLQNHIKTLKNWMAEVDIFLKEEWPALGDSEILRKQLKQCRLLVSDIQTIQPSL

SEQ ID NO: 25 - protein, 101 aa, Sus scrofa
LRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLT

SEQ ID NO: 26 - protein, 101 aa, Solanum tuberosum
MAERVLTRVHSLRERLDATLAAHRNEILLFLSRIESHGKGILKPHQLLAEFESIHKEDKDKLNDHAFEEVLKSTQEAIVLPPWVALAIRLRPGVWEYVRVN

SEQ ID NO: 27 - protein, 101 aa, Sus scrofa
ALLLKPEFFFKFSWLYKKHKESVKDLKENMEILIEKKRCSIITAEKLEDCMDFATELILAEKRGELTKENVNQCILEMLIAAPDTLSVTVFFMLFLIAKHP

SEQ ID NO: 28 - protein, 151 aa, Sus scrofa
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGN

SEQ ID NO: 29 - protein, 201 aa, Salmo salar
NQLLGRKVFAVSKKVHTTRARALGVLTEDDTQIILLDTPGLTTPTKVKRHQLEKSLLEDPWNTVKEAGLVVVMVDVSDKWACNKLDFEVLKCLTQHPDVPAVLVLNKVDLLKSKSRLLEITADLTCGVVNGRKLQVRRVIKPPWAERRTDREARTSGSGDEEKPGGDVADGEGSEALSGLSKEQLRALKTQQGWAHFKDVF

SEQ ID NO: 30 - protein, 76 aa, Sus scrofa
TDLPLCLQLNIMQRLSDGRDLVSLGQVAPDLHVLSEDRLLWKKLCQYHFSERQIRKRLILSDKGQLDWKKMYFKLV

SEQ ID NO: 31 - protein, 201 aa, Sus scrofa
TAIKAAAQCYIDLIIKESDNNVKLIVLDRLIELKEHPAHERVLQDLVMDILRVLSTPDLEVRKKTLQLALDLVSSRNVEELVIVLKKEVIKTNNVSEHEDTDKYRQLLVRTLHSCSVRFPDMAANVIPVLMEFLSDSNEAAAADVLEFVREAIQRFDNLRMLIVEKMLEVFHAIKSVKIYRGALWILGEYCSTKEDIQSVM

SEQ ID NO: 32 - protein, 76 aa, Sus scrofa
MDGELEQLEKWFTAEAKLLFHLRQLLKELKGLSSVVKYDEDLLFKGVDLLKAQVTELLQRLLHRAFIVETQPCMPQ

SEQ ID NO: 33 - protein, 126 aa, Salmo salar
LDSQFSYQHAIEESVVLIYDPIKTAQGSLSLKAYRLTPKLMEICKEKDFSAEGLKKAMIGFEHMFEEVPIVIKNSHLINVLMWELEEKCTVADKHELLNLSSSNHLEKSLQLLMDRVDDMSQDIVK

SEQ ID NO: 34 - protein, 101 aa, Sus scrofa
LLAKLRKDIRPECREDFVLAITGKKAPGCVLSNPDQKGKMRRIDCLRQADKVWRLDLVMVILFKGIPLESTDGERLVKAAQCGHPVLCVQPHHIGVAVKEL

SEQ ID NO: 35 - protein, 126 aa, Solanum tuberosum
VSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKL

SEQ ID NO: 36 - protein, 126 aa, Sus scrofa
LFRCELSVEKSTVLQSELESCKELQELEPENKWCLLTIILLMRALDPLLYEKETLQYFQTLKAVDPMRAAYLDDLRSKFLLENSVLKMEYADVRVLHLGHKDLTVLCHLEQLLLVTHLDLSHNRLR

SEQ ID NO: 37 - protein, 126 aa, Sus scrofa
LLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGV

SEQ ID NO: 38 - protein, 201 aa, Sus scrofa
IRLLMDGEEPLPMLPSYKNFKGTIEELAPNQYVISGEVAILNSTTIEISELPIRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKV

SEQ ID NO: 39 - protein, 176 aa, Sus scrofa
PMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDSDDSDCPYSEKVPSIKIPMDIMEQQPFLSDSKPSDRERSPTFLERH

SEQ ID NO: 40 - protein, 101 aa, Solanum tuberosum
EEFPEKVAVQMNDTHPTLCIPELMRILIDLKGLNWNEAWNITQRTVAYTNHTVLPEALEKWSYELMQKLLPRHVEIIEAIDEELVHEIVLKYGSMDLNKLE

SEQ ID NO: 41 - protein, 76 aa, Sus scrofa
IVLVDDASERDFLKRPLESYVKKLKVPVHVIRMEQRSGLIRARLKGAAVSKGQVITFLDAHCECTVGWLEPLLARI

SEQ ID NO: 42 - protein, 126 aa, Solanum tuberosum
LSPVFSKHQTDLEKDYVESDTKKGQNKKQYKSNTEAELDLFLKRYLLFQLRWNDALNKRMLENIKVYCLLLRLINPTKITISSIQRREMSLDIMLIQANLPLTDLMKKGVLIIEPIRLSVKHNGQF

SEQ ID NO: 43 - protein, 151 aa, Salmo salar
MVQMLIDDTSSEILDELYRISKEHSGNRTEAQKVVKDLVKVVVKVGVLFRHNRFSKEELSLAQDFKKKLHQGVMTAISFQEVEFTFDKAVMTELLTDCRDILLKLVEKHLTLKSFGRIRHVFNHYSDPDLLTNLYTPGGPLWPNLTKICNG

SEQ ID NO: 44 - protein, 201 aa, Sus scrofa
CRLRKCYEVGMVKCGSRRERCGYRIVRKQRNSEGHLHCLSRAKKNGDHTTRVKELLLSTLSPEQLVLTLLEAEPPHVLVSRPSTPFTEASMMMSLTKLADKELVHMISWAKKIPGFMELSLYDQVRLLESCWLEVLMVGLMWRSIDHPGKLIFAPDLVLDRDEGKCVEGILEIFDMLLATTSRFRELKLQHKEYLCVKAMI

SEQ ID NO: 45 - protein, 76 aa, Sus scrofa
FGLTVILFLLIFSKQQRIKMLILPPVPVPKIKGIDPDLLKEGKLEEVNTILAIHDNYKHEFYSDDSWVEFIELDID

SEQ ID NO: 46 - protein, 101 aa, Capra hircus
LLRISLLLIQSWLGPLQFLSRVFTNSLVFGTSDRVYEKLKDLEEGILALMRELEDVTPRAGQILKQTYDKFDTNMRSDDALLKNYGLLSCFRKDLHKTETY

SEQ ID NO: 47 - protein, 76 aa, Solanum tuberosum
ALSKIKLYAKEKEEQIDDPILNKKIFKVDDGELLVLVAKSSGKTKVHLATDLNQPITLHWALSKSPGEWMVPPSSI

SEQ ID NO: 48 - protein, 76 aa, Sus scrofa
KLAEAERVGLHKVFKLQTSLTCNSMVLFDHVGCLKKYDTVLDILRDFFELRLKYYGLRKEWLLGMLGAESAKLNNQ

SEQ ID NO: 49 - protein, 101 aa, Sus scrofa
KELVHMISWAKKIPGFMELSLYDQVRLLESCWLEVLMVGLMWRSIDHPGKLIFAPDLVLDRDEGKCVEGILEIFDMLLATTSRFRELKLQHKEYLCVKAMI

SEQ ID NO: 50 - protein, 101 aa, Sus scrofa
IVELKHEIHVWRLTAQRISPASREETAVRGLLLEKVLSLERLLARRLHSFHRQISQEDKNWETNIQELQKKHRISDRTLLTKCVTVLGLVIFMFFLNSFVP

SEQ ID NO: 51 - protein, 101 aa, Sus scrofa
KLEQLQGIITATSANVELVLETLAEMDGLEAFLAKDRHADPDFTKKLWAYLTINQLLDERSRAPSAAVKKKITKSILQMSLDHHIVTPLTAMVVENEAGDE

SEQ ID NO: 52 - protein, 176 aa, Sus scrofa
RLKEKKLVKEVIAVSCGPAQCQETIRTALAMGADRGIHVEVPAAEAHHLGPLQVARVLAKLAQKEKVDLVLLGKQAIDDDCNQTGQMTAGFLDWPQGTFASQVTLEGDKVKVEREIDGGLETLRLKLPAVVTADLRLNEPRYATLPNIMKAKKKKIEVIKAGDLGVDLTSKLSVVS

SEQ ID NO: 53 - protein, 76 aa, Solanum tuberosum
IPEVQQLIAELNEILAHDVVDEAGVWKKKLTPQCLELFELLPLAIQEQLLLERDPHGNVQVAKIETEKMLIQMVET

SEQ ID NO: 54 - protein, 201 aa, Sus scrofa
GMYEKGIIFNNDPALWKAVRTYFMKALSGPGLVRMVTVCADSITKHLDKLEEVRNDLGYVDVLTLMRRIMLDTSNNLFLGIPLDEKAIVCKIQGYFDAWQALLLKPEFFFKFSWLYKKHKESVKDLKENMEILIEKKRCSIITAEKLEDCMDFATELILAEKRGELTKENVNQCILEMLIAAPDTLSVTVFFMLFLIAKHP

SEQ ID NO: 55 - protein, 151 aa, Solanum tuberosum
EILLFLSRIESHGKGILKPHELLAEFDAIRQDDKNKLNEHAFEELLKSTQEAIVLPPWVALAIRLRPGVWEYIRVNVNALVVEELSVPEYLQFKEELVDGASNGNFVLELDFEPFTASFPKPTLTKSIGNGVEFLNRHLSAKMFHDKESMT

SEQ ID NO: 56 - protein, 76 aa, Sus scrofa
LTMQLLDCNFSDENVRAIAVQKLESLEDDDVLHYLLQLVQAVKFEPYHDSALARFLLKRGLRNKRIGHFLFWFLRS

SEQ ID NO: 57 - protein, 76 aa, Capra hircus
TLVQRDGRNRYDVHVDDMLECVKGPNIAAIVGGTVGGVVLVGILLLVIWKALTHLSDLREYHRFEKEKLKSQWNND

SEQ ID NO: 58 - protein, 176 aa, Sus scrofa
IVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQS

SEQ ID NO: 59 - protein, 101 aa, Sus scrofa
DYRTRVSGVTPQHMVGATPFAVARLEILQLLKGKLVVGHDLKHDFQALKEDMNRYTIYDTSTDMLLWREAKLDHCRRVSLRVLCERLLHKSIQNSLLGHSS

SEQ ID NO: 60 - protein, 201 aa, Sus scrofa
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILVCDAYRKDLQHPNEFIRGSTLRFLCKLKEAELLEPLMPAIRACLEHRHSYVRRNAVLAIYTIYRNFEHLIPDAPELIHDFLVNEKDASCKRNAFMMLIHAD

SEQ ID NO: 61 - protein, 151 aa, Sus scrofa
LILNNLDNFKQFDKIFPALVAGFPIHVFKTGHYAREKLAEGLRLQKLRKRDHISELVRFLNDTLSTLDDAEKAKSLLAVLWASQANTIPATFWCLFQTIRSPEAMKAASEEVNKTLEKAGQKISLDDKPIYLNQIELDSMPVLDSIIKESL

SEQ ID NO: 62 - protein, 151 aa, Sus scrofa
MIEVPTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSLEEERNVPLATDLIRISQYRFTVSDLMRMEKIVLEKVCWKVKA

SEQ ID NO: 63 - protein, 76 aa, Agaricus bisporus
MHDEDQYLHLIRRVLDTGDLRPDRTGTGTISLFAPPNLRFSLRESTVPLLTTKRTFLRGIVEELLWFTNGLTDSKI

SEQ ID NO: 64 - protein, 76 aa, Solanum tuberosum
IEIWTNGSLTPKEALHDASRNLIDLFIPFLHMEEDNLYLQDNQHTVPLSPFTFHDKLAKLIKNKKKIALKSIFIDQ

SEQ ID NO: 65 - protein, 126 aa, Solanum tuberosum
PLILSLDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGV

SEQ ID NO: 66 - protein, 126 aa, Salmo salar
MVLETISRIIKIQLPAYLKKLPLPETIGGFARLTVSEWLRLLPLLGILALLGYLTIRPFLPKKKKQKDSLINLKIQKENPKVVNEIDIEDLKRTNVCYCRCWRSKTFPVCDKSHIKHNELTGDNVG

SEQ ID NO: 67 - protein, 76 aa, Salmo salar
NQLLGRKVFAVSKKVHTTRARALGVLTEDDTQIILLDTPGLTTPTKVKRHQLEKSLLEDPWNTVKEAGLVVVMVDV

SEQ ID NO: 68 - protein, 126 aa, Sus scrofa
GQNSSTEGLSLSWVDFIKRESPPGKLPFWTWLDKILDLVHDHLKDLWKDGHIMGFVSRSEERRLLKKTISGTFLLRFSETLEGGITCSWVEHQDDDKVLIYSLQPFTKEVLQSLPLTKIISQYQLL

SEQ ID NO: 69 - protein, 76 aa, Sus scrofa
RVTVVVGASQDIIPQLKKKYDVDTLDMVFLDHWKDRYLPDTLLLEECGLLRKGTVLLADNVICPGAPDFLAHVRGC

SEQ ID NO: 70 - protein, 226 aa, Solanum tuberosum
NFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKL

SEQ ID NO: 71 - protein, 76 aa, Solanum tuberosum
MESKFAHIIVFFLLATSFETLLARKESDGPEVIELQKEFECNGKQRWPELIGVPTKLAKGIIEKENSLITNVQILL

SEQ ID NO: 72 - protein, 251 aa, Sus scrofa
LLAEELPLRQGTLKQLNETGGTVLVSAPISPEEQDKIENKLKQTNLQWIKVSRILPEKQGEIEAHIKDLGQFEEQLNHLLVWLSPIKNQLEIYNQPNQTGPFDIKETEVAVQAKQLDVEGILSKGQHLYKEKPATQPVKRKLEDLSSEWKAVTHLLQELRAKWPGPTPGLTTIEAPTSQTVTLVTQPTVTKETAISKPEMPSSLLLEVPALADFNRAWTELTDWLSLLDRVIKSQRVMVGDLEDINEMIIK

SEQ ID NO: 73 - protein, 151 aa, Solanum tuberosum
SGEMVINMEWGNFRSSHLPLTEYDHALDNESLNPAEQIFEKMTSGMYLGEILRRVLTRVAEEVLAFLAMRSLQSLKDSFVLRTPDMSAMHHDTSPDLKVVGEKLKDILEISNTSLKTRKLVLSLCNIVATRGARLDAAGVLGILKKMGRDT

SEQ ID NO: 74 - protein, 101 aa, Sus scrofa
MWGLLIFSVLLGGVLAKEDFVGHQVLRISVDDEAQVQKVKELEDLEHLQLDFWRGPARPGFPIDVRVPFPSIQAVKVFLEAHGIRYTIMIEDVQLLLDEEQ

SEQ ID NO: 75 - protein, 76 aa, Solanum tuberosum
IKNLRMLQEMYNAWPFFRVTIDLVEMVFAKGDPGIAALFDKLLVSEDLWSFGELLRSKYEETKSLLLQIAGHKDLL

SEQ ID NO: 76 - protein, 76 aa, Capra hircus
MAAPLSVEVEFGGGAELLFDGVKKHQVTLPGQEEPWDIRSLLVWIKKNLLKERPELFIQGDSVRPGILVLVNDADW

SEQ ID NO: 77 - protein, 126 aa, Solanum tuberosum
PDELNLDLIRSAKVFHYGSISLIVEPCRSAHLKAMEVAKEAGALLSYDPNLRLPLWSSEAEARKAIKVSDVELEFLTGSDKIDDESAMSLWHPNLKLLLVTLGEKGCNYYTKKFHGSVGGFHVKTV

SEQ ID NO: 78 - protein, 151 aa, Sus scrofa
KMYLMLDNKRKEVVHKIIELLNVTELTQKALINDELVEWKRRQQSACIGGPPNACLDQLQNWFTIVAESLQQVRQQLKKLEELEQKYTYEHDPITKNKQALWDRTFSLFQQLIQSSFVVERQPCMPTHPQRPLVLKTGVQFTVKLRLLVKL

SEQ ID NO: 79 - protein, 76 aa, Salmo salar
AFPTEQLNEVGELLQTRGHEVGVTTGRKRRCGWLDLVILRYANMINGFTAFALTKLDILDVMDEIKVGVSYKLKGK

SEQ ID NO: 80 - protein, 176 aa, Malus domestica
MSTVTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSK

SEQ ID NO: 81 - protein, 76 aa, Sus scrofa
VSYYTSFVVKDELWLVMKLLSGGSVLDIIKHIVAKGEHKSGVLDEATIATILREVLEGLEYLHKNGQIHRDVKAGN

SEQ ID NO: 82 - protein, 276 aa, Sus scrofa
LDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQVAPDLHVLSEDRLLWKKLCQYHFSERQIRKRLILSDKGQLDWKKMYFKLV

SEQ ID NO: 83 - protein, 126 aa, Salmo salar
MVLETISKIIKTQLPAYLKKFPLPETIGGFARLTVLDWLRLLPLLGILALLGYLTIRPFLPKKKKQKDSLINLKIQKENPKVVNEIDIEDLKSTNVCYCRCWRSKTFPVCDKSHIKHNELTGDNVG

SEQ ID NO: 84 - protein, 176 aa, Meleagris gallopavo
MATEGDKLLGGRFVGSVDPIMEILSSSISTEQRLTEVDIQASMAYAKALEKASILTKTELEKILSGLEKISEESSKGVLVMTQSDEDIQTAIERRLKELIGDIAGKLQTGRSRNEQVVTDLKLLLKSSISVISTHLLQLIKTLVERAAIEIDIIMPGYTHLQKALPIRWSQFLLSH

SEQ ID NO: 85 - protein, 101 aa, Sus scrofa
ISGLHASINVHLSARYLLQDTWLEKKWGHNITEFQQRFDGILTEGEGPRRLKNLYFLYLIELRALSKVVPFFERPDFQLFTGNKVQDAENKMLLLDILHEI

SEQ ID NO: 86 - protein, 276 aa, Sus scrofa
FVVAVLAEEIHALRLNFLQTIAGKIVSKQKLELKTTEAGPRLKSGKQVAAIIKAVDSKYTAIPIVGQVFQSECKGCSSLSQHWQSVRKHLQPDNLSKTEAVRSFLTFIQHLRTAKKEEILQILKAENKDILPQLVDAVTSAQTPDSLDAILDFLDFKSDSNIILQERFLYACGFASHPDEELLRALISKFKGSFGSNDIRESVMIIIGALVRKLCQNEGCKLKAVVDAKKLILGGLERAEKKEDTMMYLLALKNARLPEGIPLLLKYAEAAEGPIS

SEQ ID NO: 87 - protein, 126 aa, Capra hircus
MLSAEEKASVLSLFAKVNVEEVGGEALGRLLVVYPWTQRFFEHFGDLSSADAILGNPKVKAHGKKVLDTFSEGLKQLDDLKGAFASLSELHCDKLHVDPENFRLLGNVLVVVLARRFGGEFTPELQ

SEQ ID NO: 88 - protein, 151 aa, Salmo salar
KIITPAITRVVDFAKKLPMFSELPCEDQIILLKGCCMEIMSLRAAVRYDPESETLTLSGEMAVKREQLKNGGLGVVSDAIFDLGKSLAQFNLDDSEVALLQAVLLMSSDRSGLTLVDKIEKCQETYLLAFEHYINHRKHNIPHFWPKLLMK

SEQ ID NO: 89 - protein, 276 aa, Meleagris gallopavo
MATEGDKLLGGRFVGSVDPIMEILSSSISTEQRLTEVDIQASMAYAKALEKASILTKTELEKILSGLEKISEESSKGVLVMTQSDEDIQTAIERRLKELIGDIAGKLQTGRSRNEQVVTDLKLLLKSSISVISTHLLQLIKTLVERAAIEIDIIMPGYTHLQKALPIRWSQFLLSHAVALTRDSERLGEVKKRITVLPLGSGVLAGNPLEIDRELLRSELDMTSITLNSIDAISERDFVVELISVATLLMIHLSKLAEDLIIFSTTEFGFVTLSDA

SEQ ID NO: 90 - protein, 101 aa, Sus scrofa
MGRMHAPGKGLSQSALPYRRSVPTWLKLTSDDVKEQIYKLAKKGLTPSQIGVILRDSHGVAQVRFVTGNKILRILKSKGLAPDLPEDLYHLIKKAVAVRKH

SEQ ID NO: 91 - protein, 226 aa, Sus scrofa
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSREQLWMFSCLIPGFSAPQSEYGPRTLDNLINPPLNLQETQVTIEEITPLVPPQSGDKGQEDLTSYFLEALLKYIVIQVKSLE

SEQ ID NO: 92 - protein, 176 aa, Capra hircus
LYHLLKSEKMLLEDVKANITEMLAGGVDTTSMTLQWHLYEMARSLNVQEMLREEVLNARRQAEGDISKMLQMVPLLKASIKETLRLHPISVTLQRYPESDLVLQDYLIPAKTLVQVAIYAMGRDPAFFSNPDKFDPTRWLGKDKDLIHFRNLGFGWGVRQCVGRRIAELEMTLFLI

SEQ ID NO: 93 - protein, 126 aa, Solanum tuberosum
ELIGLLRAERMGRALEEAICYRVVLLGITRASLNTQSFISEASFQETARVLAKAALRGRIDWLKGLKENVVLGGVIPVGTGFKGLVHPSKQHNNIPLETKKTNLFEGEMRDILFHHRKLFDSCLSK

SEQ ID NO: 94 - protein, 76 aa, Sus scrofa
DKVLALSLEDEHLLYGDIIRQDFLDTYNNLTLKTIMAFRWVTEFCPNARYIMKTDTDVFINTGNLVKYLLNLNHSE

SEQ ID NO: 95 - protein, 126 aa, Sus scrofa
GMHEKGIIFNNNPVLWKAVRTYFMKALSGPGLVRMVTVCADSITKHLDKLEEVRNDLGYVDVLTLMRRIMLDTSNNLFLGIPLDEKAIVCKIQGYFDAWQALLLKPDIFFKIPWLYRKYEKSVKDL

SEQ ID NO: 96 - protein, 126 aa, Solanum tuberosum
KQQYTLCSASLQDIIARFEKRSGNAVNWDQFPEKVAVQMNDTHPTLCIPELLRILMDVKGLSWKQAWEITQRTVAYTNHTVLPEALEKWSFTLLGELLPRHVEIIAMIDEELLHTILAEYGTEDLD

SEQ ID NO: 97 - protein, 226 aa, Sus scrofa
DHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGHVLPVVSYIRKCLEKLDTDISLIRHFVTEVLDVIAPPYTSDFVQLFLPILENDSIAGTIKTEGEHDPVT

SEQ ID NO: 98 - protein, 76 aa, Sus scrofa
MSGALDVLQMKEEDVLKFLAAGTHLGGTNLDFQMEQYIYKRKSDGIYIINLKRTWEKLLLAARAIVAIENPADVSV

SEQ ID NO: 99 - protein, 226 aa, Sus scrofa
LTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIDMLQKVTIDIKSLSAEKYDVSSQVISQLKQKLENLQNLNLPQSFRVPYDPGLKAGALVIEKCKVMASKKKPLWLEFKCADPTALSNETIGIIFKHGDDLRQDMLILQILRIM

SEQ ID NO: 100 - protein, 251 aa, Sus scrofa
MKGGIRKDRRGGRMLKHKRQRDDGEGRNEAVPPGDMRSANLWPSPLLIKHTKKNSPVLSLTADQMISALLEAEPPIIYSEYDPTRPLSEASMMGLLTNLADRELVHMINWAKRVPGFLDLSLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQH

SEQ ID NO: 101 - protein, 76 aa, Sus scrofa
GHEWGVTTGRKRRCGWLDLMILRYAHMINGFTALALTKLDILDTLDEVKVGVSYKLSGKRIPYFPANQEILQKVEV

SEQ ID NO: 102 - protein, 126 aa, Solanum tuberosum
DVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIP

SEQ ID NO: 103 - protein, 201 aa, Solanum tuberosum
KSIGNGVEFLNRHLSAKMFHDKESMTPLLEFLRAHHYKGKTMMLNDRIQNSNTLQNVLRKAEEYLIMLPPETPYFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRI

SEQ ID NO: 104 - protein, 151 aa, Malus domestica
VYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAKCVPNSIVMHIGDTLEILSNGKYKSILHRGMVNKEKV

SEQ ID NO: 105 - protein, 251 aa, Solanum tuberosum
NVNALIVEELTVPEFLQFKEELVNGTSNDNFVLELDFEPFTASFPKPTLTKSIGNGVEFLNRHLSAKMFHDKESMTPLLEFLRVHHYKGKTMMLNDRIQNLYTLQKVLRKAEEYLTTLSPETSYSAFEHKFQEIGLERGWGDTAERVLEMICMLLDLLEAPDSCTLEKFLGRIPMVFNVVILSPHGYFAQENVLGYPDTGGQVVYILDQVPALEREMLKRIKEQGLDIKPRILIVTRLLPDAVGTTCGQRL

SEQ ID NO: 106 - protein, 101 aa, Sus scrofa
NLRAYRTFHVMLARLLEDQREHFTPAEDDFHQAIHTIVLQVAAFAYQLEELMVLLEHKVPPSEADGTPLSVGGGGLFEKKLWGLKVLQELSQWTVRSIRDL

SEQ ID NO: 107 - protein, 76 aa, Salmo salar
AFPTEQLNEVGELLQTRGHEVGVTTGRKRRCGWLDLVILRYANMINGFTAFALTKLDILDVMDEIKVGVSYKLNGK

SEQ ID NO: 108 - protein, 126 aa, Sus scrofa
MVHLSAEEKEAVLGLWGKVNVDEVGGEALGRLLVVYPWTQRFFESFGDLSNADAVMGNPKVKAHGKKVLQSFSDGLKHLDNLKGTFAKLSELHCDQLHVDPENFRLLGNVIVVVLARRLGHDFNPN

SEQ ID NO: 109 - protein, 201 aa, Capra hircus
SHLILHLKQPVLLVDILVDIVSSLDCLELRDTNLHTFHFSEASISEMNTSVKKLIFRNVQFTDESFVEVVKLFNYVSGILEVEFDDCTHDGIGDFRALSLDRIRHLGNVETLTIRKLHIPQFFLFHDLSSIYPLTGKVKRVTIESSKVFLVPCLLSQHLKSLEYLDLSENLMSEETLKNSACKDAWPFLQTLVLRQNRLKS

SEQ ID NO: 110 - protein, 76 aa, Solanum tuberosum
MELKFAHIIVFFLLATSFETLMARKESDGPEVIQLLKEFQCKGKLRWPELIGVPTKLAKGIIEKENSLISNVHILL

SEQ ID NO: 111 - protein, 101 aa, Capra hircus
DRIRHLGNVETLTIRKLHIPQFFLFHDLSSIYPLTGKVKRVTIESSKVFLVPCLLSQHLKSLEYLDLSENLMSEETLKNSACKDAWPFLQTLVLRQNRLKS

SEQ ID NO: 112 - protein, 126 aa, Sus scrofa
GGQPLQNKVQLKGRDLLTLKNFTGEEIKYILWLSADLKFRIKQKGEYLPLLQGKSLGMIFEKRSTRTRLSTETGFALLGGHPCFLTTQDIHLGVNESLKDTARVLSSMTDAVLARVYKQSDLDILA

SEQ ID NO: 113 - protein, 251 aa, Solanum tuberosum
RRRRLKVDKISKEELYEYWSQITDQSFDSRLQIFFDMVDKNEDGRIGEEEVKEIIMLSASANKLSRLKEQAEEYAALIMEELDPERLGYIELWQLETLLLQKDTYLNYSQALSYTSQALSQNLQGLRKRSPIRRMSTKLVYSLQENWKRIWVLVLWILIMIGLFLWKFYLYKQKSAFQVMGYCLLTAKGAAETLKFNMALILLPVCRNTITFLRSTKLSCFVPFDDNINFHKTVAAAIVTGIILHAGNHLV

SEQ ID NO: 114 - protein, 76 aa, Sus scrofa
TTRVGIGAFPTEQDNEIGELLQTRGREFGVTTGRKRRCGWLDLVLLKYAHMINGFTALALTKLDILDMFTEIKVGV

SEQ ID NO: 115 - protein, 101 aa, Sus scrofa
MTAAENVCYTLINVPMDSEPPSEISLKNDLEKGDVKSKTEALKKVIIMILNGEKLPGLLMTIIRFVLPLQDHTIKKLLLVFWEIVPKTTPDGRLLHEMILV

SEQ ID NO: 116 - protein, 201 aa, Sus scrofa
QEDLEYKLKGLIDLTLDKSAKTRQAALEGIKNALASRMLYEFILERRMTLTDSIERCLKKGKSDEQRAAAALASVLCIQLGPGIESEEVLKTLGPVLKKIICDGTASIQARQTCATCFGVCCFIATDDITELYSTLQCLENIFTKSYLKEKDSNVICSTPNTALHISSLLAWTLLLTICPLSEVKKKLEMHVHKLPSLLSS

SEQ ID NO: 117 - protein, 76 aa, Sus scrofa
CSDSKQHFEWLIKYSPLHNVKLPEADDIQYPSMLLLTADHDDRVVPLHSLKFIATLQYIVGRSRKQNNPLLIHVDT

SEQ ID NO: 118 - protein, 76 aa, Capra hircus
VLLEATIREVLRIRPVAPMLIPHKAIIDSSIGDLTIDKGTDVVVNLWALHHNEKEWQQPDLFMPERFLDPTGTQLI

SEQ ID NO: 119 - protein, 76 aa, Sus scrofa
LVMIDELITEHKMTRDLAQPPRDLTDAFLDEMKEAKGNPESSFNDENLRLVVAHLFSAGMITTSTTLAWALLLMIL

SEQ ID NO: 120 - protein, 126 aa, Sus scrofa
SFSHLDLSEEDSDDPSVTLDLSQLSMLPHLADLVSYSIQKVIGFAKMIPGFRDLTAEDQIVLLKSSAIEVIMLRSNQSFTMDDMSWTCGSRDYKYQVSDVAKAGHSLELIEPLIKFQVGLKKLNLH

SEQ ID NO: 121 - protein, 126 aa, Sus scrofa
TAMLHDFTQQVQVIDMLQKVTIDIKSLSAEKYDVSSQVISQLKQKLENLQNLNLPQSFRVPYDPGLKAGALVIEKCKVMASKKKPLWLEFKCADPTALSNETIGIIFKHGDDLRQDMLILQILRIM

SEQ ID NO: 122 - protein, 101 aa, Malus domestica
EKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITN

SEQ ID NO: 123 - protein, 101 aa, Malus domestica
EKLLDLLCENLGLEKGYLKKAFYGSKGPNFGTKVSNYPPCPKPDLIKGLRAHTDAGGIILLFQDDKVSGLQLLKDGEWMDVPPVHHSIVINLGDQIEVITN

SEQ ID NO: 124 - protein, 276 aa, Solanum tuberosum
ELKEKFKRMCDKSMIKKRYMHLTEEILKENPNMCAYMAPSLDARQDIVVVEVPKLGKEAAQKAIKEWGQPKSKITHLVFCTTSGVDMPGCDYQLAKLLGLRPSVKRLMMYQQGCFVGGTVLRLAKDLAENNKGARVLVVCSEITAVTFRGPSESHLDSLVGQALFGDGAAAIIMGSDPIIGVERPLFELVSAAQTLVPDSEGAIDGHLREVGLTFHLLKDVPGLISKNIEKSLLEAFQPLGISDWNSLFWIAHPGGPAILDQVELKLGLKQEKLRA

SEQ ID NO: 125 - protein, 176 aa, Sus scrofa
MQRSPLEKASIFSKLFFSWTRPILRKGYRQRLELSDIYHISSSDSADNLSEKLEREWDRELASKKNPKLINALRRCFFWRFMFYGIILYLGEVTKAVQPLLLGRIIASYDPDNKAERSIAIYLGVGLCLLFIVRTLLLHPAIFGPHHIGMQMRIAMFSLIYKKTLKLSSRVLDKIS

SEQ ID NO: 126 - protein, 151 aa, Capra hircus
TLDILSDNQKGIAFADHGAHWQLHRKLVLNAFALFKDGNLKLEKIINQEANVLCDFLATQHGQSIDLSEPLSLAVTNIISFICFNFSFKNEDPALKAIQNVNDGILEVLSKEILLDIFPALKIFPSKAMEKMKGCVETRNELLNEILEKCQ

SEQ ID NO: 127 - protein, 276 aa, Sus scrofa
KKHREEELAERRKLYRWGNWKDGLILNIASTGIHDLPVDERFLEDKRIDFEASLAKGLADLAVKDSLNVLMSWNSLDSFNRIFWCGQSKLAEQVRDSWKEDALFGYQFLNGTNPMLLRHSVELPARLKFPPGMEELQAQLEKELQGGTLFEADFSLLDGIKANVILCSQQYLAVPLVMLKLQPDGKLLPMVIQLQLPREGSPLPPLFLPTDPPMVWLLAKCWVRSSDFQLHELHSHLLRGHLMAEVIAVATMRCLPSIHPIFKLLIPHFRYTMEIN

SEQ ID NO: 128 - protein, 126 aa, Capra hircus
VNDGILEVLSKEILLDIFPALKIFPSKAMEKMKGCVETRNELLNEILEKCQENFTSDSITNLLHILMQAKVNADNNNAGPDQDSKLLSNRHMLATIADIFGAGVETTTSVIKWIVAYLLHHPSLKK

SEQ ID NO: 129 - protein, 126 aa, Sus scrofa
VLQNLLTIEERYLPQCSYFKCVQKDIQPYMRRMVATWMLEVCEEQKCEEEVFPLAINYLDRFLAGVPTPKTHLQLLGAVCMFLASKLKETIPLTAEKLCIYTDNSIKPQELLEWELVVLGKLKWNL

SEQ ID NO: 130 - protein, 126 aa, Sus scrofa
MKATIVFLLLAQVSWAGPFQQKGLFDFMLEDEASGIGPEDRFPEVPELEPLGPMCPFRCQCHLRVVQCSDLGLDKVPKDLPPDTALLDLQNNKITEIKDGDFKNLKNLHTLILINNKISKISPGAF

SEQ ID NO: 131 - protein, 226 aa, Sus scrofa
MKATIVFLLLAQVSWAGPFQQKGLFDFMLEDEASGIGPEDRFPEVPELEPLGPMCPFRCQCHLRVVQCSDLGLDKVPKDLPPDTALLDLQNNKITEIKDGDFKNLKNLHTLILINNKISKISPGAFAPLVKLERLYLSKNQLKELPEKMPKTLQELRVHENEITKVRKAVFNGLNQMIVVELGTNPLKSSGIENGAFQGMKKLSYIRIADTNITTIPQGLPPSLTE

SEQ ID NO: 132 - protein, 151 aa, Solanum tuberosum
QSVSEQKSRFQVVFDRLRINQYSIDWSEVIDKKDLSKSLRFFLSKSLLFLSKLLLFLSNSLPFFCVSFGNIPIHRSEIYIYEELKGPNDQLCNQLLESIGLQIVHLKKLKPFLLDDHDTSQKSKFLINGGTISPFLFNKIPKWMIDSFHTR

SEQ ID NO: 133 - protein, 226 aa, Salmo salar
LANASPFLRTGWAARPPGTNNGHGFRFTPACFITSDAFLSRLAKGKAETDDTHYHHPASVLPDSAEQLSLLVKDPDQPENSKVLRVAIIGAPNAGKSTLSNQLLGRKVFAVSKKVHTTRARALGVLTEDDTQIILLDTPGLTTPTKVKRHQLEKSLLEDPWNTVKEAGLVVVMVDVSDKWACNKLDFEVLKCLTQHPDVPAVLVLNKVDLLKSKSRLLEITADLTC

SEQ ID NO: 134 - protein, 101 aa, Salmo salar
MATDAKRLKTEGSDPLQSFLQWCEGVGLKLNNKVYISKEGTVAEYGMLAKEDIDEGELLFTIPRMALLHQGTTKVLAVLEEGKASLENTSGWVPLLLALMY

SEQ ID NO: 135 - protein, 101 aa, Solanum tuberosum
IRGYMLITQSILRKYILLPSLIIAKNLGRMLFLQLPEWSEDLQEWNREMQIKCTYNGVQLSETEFPKDWLRDGIQIKILFPFCLKPWHISKLYPSRGELMK

SEQ ID NO: 136 - protein, 76 aa, Sus scrofa
TEVLLKVLDKAHRNYSESFFEAASMMSQLSHKHLVLNYGVCVCGEENILVQEFVKFGSLDTYLKKNKNSINILWKL

SEQ ID NO: 137 - protein, 76 aa, Sus scrofa
NDCLITFLITTDNEGKTIIHSISEKDCPKPPNSPMIMLGVSLAILLIGVVLLCIWKLLVSFHDRKEVAKFEAERSK

SEQ ID NO: 138 - protein, 201 aa, Sus scrofa
LELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQVAPDLHVLSEDRLLWKKLCQYHFSERQIRKRLILSDKGQLDWKKMYFKLVRCYPRKEQYGDTLQLCRHCHILSWK

SEQ ID NO: 139 - protein, 76 aa, Sus scrofa
LWDRTFSLFQQLIQSSFVVERQPCMPTHPQRPLVLKTGVQFTVKLRLLVKLQKLNYNLKVKVLFDKDVSERNTVKG

SEQ ID NO: 140 - protein, 76 aa, Salmo salar
KAYTTRVGIGAFPTEQLNATGELLQTRGHEVGVTTGRKRRCGWLDLVILRYAHMINGFTAIALTKLDILDVLDEIK

SEQ ID NO: 141 - protein, 126 aa, Capra hircus
GMHEKGIIFNNNPALWKAVRPFFTKALSGPGLVRMVTICADSITKHLDRLEEVCNDLGYVDVLTLMRRIMLDTSNILFLGIPLDESAIVVKIQGYFDAWQALLLKPDIFFKISWLCRKYEKSVKDL

SEQ ID NO: 142 - protein, 201 aa, Prunus persica
RVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPV

SEQ ID NO: 143 - protein, 276 aa, Capra hircus
VNDGILEVLSKEILLDIFPALKIFPSKAMEKMKGCVETRNELLNEILEKCQENFTSDSITNLLHILMQAKVNADNNNAGPDQDSKLLSNRHMLATIADIFGAGVETTTSVIKWIVAYLLHHPSLKKRIQDSIDQNIGFNRTPTISDRNCLVLLEATIREVLRIRPVAPMLIPHKAIIDSSIGDLTIDKGTDVVVNLWALHHNEKEWQQPDLFMPERFLDPTGTQLISPSLSYLPFGAGPRSCVGEMLARQELFLFMSRLLQRFNLEIPDDGKLPSL

SEQ ID NO: 144 - protein, 276 aa, Sus scrofa
EEQGGSAVRRVAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGHVLPVVSYIRKCLEKLDTD

SEQ ID NO: 145 - protein, 76 aa, Solanum tuberosum
LELENQFLEKNILRTQTLLCDMLMRDAPLGIVSQSPNIMDLIKCDGAALLYKNKIHRLGMNPSDFQLHDIVSWLCE

SEQ ID NO: 146 - protein, 101 aa, Sus scrofa
DRELVHMINWAKRVPGFLDLSLHDQVHLLECAWLEILMIGLVWRSMEHPGKLLFAPNLLLDRNQGKCVEGMVEIFDMLLATSSRFRMMNLQGEEFVCLKSI

SEQ ID NO: 147 - protein, 101 aa, Sus scrofa
GRIILLEQGMDSLEVQKQNCCWLLVSHKPCVKDDVIVALKKANGDAILKFEPLVLHVQCRQLQDAQILHSVAIDSGFRNSGITVGKRGKTMLAVRSTHGLE

SEQ ID NO: 148 - protein, 251 aa, Sus scrofa
TGRLHMMEEMCALSFSQELDYWGIDEIYLESCCQARYHQKKEQMNEELKREAETLREREGEEFDNTCCAEKRKKLWDLLEKPNSSVAAKILAIISIMFIVLSTIALSLNTLPELQSLDEFGQTTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFF

SEQ ID NO: 149 - protein, 201 aa, Sus scrofa
LYRLLGNDKLLSEDVKANVTEMLAGGVDTTSMTLQWHLYEMARSLNVQEMLREEVLNARRQAQGDTSKMLQLVPLLKASIKETLRLHPISVTLQRYLVNDLVLRDYMIPAKTLVQVAVYAMGRDPAFFSNPGQFDPTRWLGKERDLIHFRNLGFGWGVRQCVGRRIAELEMTLFLIHILENFKVELQHFSDVDTIFNLILM

SEQ ID NO: 150 - protein, 151 aa, Sus scrofa
ISTVREVALLRRLEAFEHPNVVRLMDVCATARTDRETKVTLVFEHVDQDLRTYLDKAPPPGLPVETIKDLMRQFLRGLDFLHANCIVHRDLKPENILVTSGGTVKLADFGLARIYSYQMALTPVVVTLWYRAPEVLLQSTYATPVDMWSVG

SEQ ID NO: 151 - protein, 126 aa, Sus scrofa
DHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKL

SEQ ID NO: 152 - protein, 201 aa, Sus scrofa
DRELVHMINWAKRVPGFLDLSLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHRRLAQLLLILSHFRHMSNKGMEHLYNMKCKNVVPLYDLLLEMLDAHRLHA

SEQ ID NO: 153 - protein, 76 aa, Sus scrofa
CGPVNCNEKIVVLLQRLKPEIKDVIEQLNLVTTWLQLQIPRIEDGNNFGVAVQEKVFELMTALHTKLEGFHTQISK

SEQ ID NO: 154 - protein, 201 aa, Meleagris gallopavo
MGKVLAAALIGIAAALAAERLLAFRNRLNATREVDPVALPNCRLIKGIEAGSEDIDILPNGLAFISSGLKYPGLKSLAPDKPGEIFLMDLNEKKPKASELRISRGFDLGSFNPHGISTYIDKDDTVYLFVVNHPHQKSTVELFKFMEEDNSLLHLKTIRHDLLTSVNDVVAVGPDSFYATNDHYFYDFILMFLEMYLGLTW

SEQ ID NO: 155 - protein, 76 aa, Sus scrofa
QAIIIVFNLNDVASLEHTKQWLADALKENDPSSVLLFLVGSKKDLSTPAQYVLMEKDALKVAHEMKAEYWAVSSLT

SEQ ID NO: 156 - protein, 251 aa, Sus scrofa
SLEEWVTQEASCLCAAFADQAGRPFSPNNLLNKAVSNVIASLTFARRFEYNDPRMLKLLDLVLEGLKEEVGLMRQVLEAMPVLRHIPGLCAKLFPRQKAFLVMIDELITEHKMTRDLAQPPRDLTDAFLDEMKEAKGNPESSFNDENLRLVVAHLFSAGMITTSTTLAWALLLMILHPDVQRRVQQEIDEVIGHVRQPEIKDQALMPFTLAVLHEVQRFGDIVPLGVAHMTSCDIEVQGFLIPKGTTLITN

SEQ ID NO: 157 - protein, 126 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIE

SEQ ID NO: 158 - protein, 76 aa, Salmo salar
MAKIELKPVGTNLLKSVSGESVELQSLWRDKPVVLFFLRRFGCQVCRWTAAEISKLEPDLTAHGIALVGIGPEETG

SEQ ID NO: 159 - protein, 101 aa, Sus scrofa
SKFGKQHIENLFNDLQDGRRLLDLLEGLTGQKLPKEKGSTRVHALNNVNKALQVLQKNNVDLVNIGSTDIVDGNHKLTLGLIWNIILHWQVKNVMKNIMAG

SEQ ID NO: 160 - protein, 176 aa, Sus scrofa
RMRRLRYKHLAFLAESSATYMQEQGSQELLAELLVHLERRWTEIDDGRTVVAMMVKIGHLSQSLMNRLEDKCLELVEQFGPEELRKVLVMLAAQNRRSVPLLRAVSYHLVQKPFTLTKSILLDLAYAYGKLGFHQTQVFQRLAADLLPHTPSLTSSEVARCTKSFAFLKWLSLPLF

SEQ ID NO: 161 - protein, 101 aa, Capra hircus
KVLQNGGGKLEKTPLYLEEDIRPEMRDDIYDPTYQDKEGPKPKLEYVWRNIILMGLLHLGALYGITLIPTCKIYTFLWVLFYYMMSALGITAGVHRLWSHR

SEQ ID NO: 162 - protein, 76 aa, Sus scrofa
LLKCVRDSDPSDPKRETIVQLIDDFRISGVNGVHVCMVLEVLGHQLLKWIIKSNYQGLPVPCVKSIVRQVLHGLDY

SEQ ID NO: 163 - protein, 226 aa, Sus scrofa
CPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQ

SEQ ID NO: 164 - protein, 226 aa, Sus scrofa
MDGELEQLEKWFTAEAKLLFHLRQLLKELKGLSSVVKYDEDLLFKGVDLLKAQVTELLQRLLHRAFIVETQPCMPQTPHRPLILKTGSKFTVRTRLLVRLQEGNESLTAEVSIDRNPPKSQGFRKFNILTSNRKTLTPEKGQSQGLIWDFGYLTLMEQRSGGAGKGNNKGPLGVTEELHIISFTVKYTYQGLKQELTTDTLPVVIISNMNQLSIAWASILWFNLLS

SEQ ID NO: 165 - protein, 276 aa, Sus scrofa
LIERATQPEEILALLGGGHCLHQNRAALMVIQLSRLLSEKPKDKALLIKDARFQHLLRLVNSQINAVWHGTLVKLLRSLYALGLPATSKELQSVEQEVRWRMRRLRYKHLAFLAESSATYMQEQGSQELLAELLVHLERRWTEIDDGRTVVAMMVKIGHLSQSLMNRLEDKCLELVEQFGPEELRKVLVMLAAQNRRSVPLLRAVSYHLVQKPFTLTKSILLDLAYAYGKLGFHQTQVFQRLAADLLPHTPSLTSSEVARCTKSFAFLKWLSLPLF

SEQ ID NO: 166 - protein, 176 aa, Meleagris gallopavo
GDIAGKLQTGRSRNEQVVTDLKLLLKSSISVISTHLLQLIKTLVERAAIEIDIIMPGYTHLQKALPIRWSQFLLSHAVALTRDSERLGEVKKRITVLPLGSGVLAGNPLEIDRELLRSELDMTSITLNSIDAISERDFVVELISVATLLMIHLSKLAEDLIIFSTTEFGFVTLSDA

SEQ ID NO: 167 - protein, 276 aa, Sus scrofa
MVLVWLLLLLTLLAGARLLWGQWKLRNLHLPPLVPGFLHLLQPNLPIYLLGLTQRLGPIYRLRLGLQDVVVLNSKRTIEEALVRKWVDFAGRPQIPSYKLASQHCPDISLGDYSLFWKAHKKLTRSALLLGVRSSMEPRVEQLTQEFCERMRAQAGTPVTIQKEFSVLTCSIICCLTFGDKEDTLVHALHDCVQDLMKTWEHWSIQILDMVPFLRFFPSPGLRRLKQAIENRDHLVEKQLRRHKESMVAGQWRDMLDYMLQEAGRQRVEEGQGQLL

SEQ ID NO: 168 - protein, 76 aa, Solanum tuberosum
FWLKNLFLVALEQLGDSLEEIRGSASGGNMLGPAYGVKSIRSKKKDWNINLIEIIDLIPNPINRITFSRNTRHLSH

SEQ ID NO: 169 - protein, 101 aa, Sus scrofa
YQDVKDWWLFGFYFCMPLVCTAIFYTLMTCEMLNRRNGSLRIALSEHLKQRREVAKTVFCLVVIFALCWFPLHLSRILKKTVYDEMDKNRCELLSFLLLMD

SEQ ID NO: 170 - protein, 276 aa, Meleagris gallopavo
GDIAGKLQTGRSRNEQVVTDLKLLLKSSISVISTHLLQLIKTLVERAAIEIDIIMPGYTHLQKALPIRWSQFLLSHAVALTRDSERLGEVKKRITVLPLGSGVLAGNPLEIDRELLRSELDMTSITLNSIDAISERDFVVELISVATLLMIHLSKLAEDLIIFSTTEFGFVTLSDAYSTGSSLLPQKKNPDSLELIRSKAGRVFGRLAAILMVLKGIPSTFSKDLQEDKEAVLDVVDTLTAVLQVATGVISTLQINKENMEKALTPELLSTDLALY

SEQ ID NO: 171 - protein, 226 aa, Solanum tuberosum
TFFDMVDKDADGRLTEEEVREIICLSASANKLSNIQKQAAEYAALIMEELDRDQKGYIMLENLEMLLLEAPIQPDGEKGLNRNLSHMLSMKLKPTLETNPIKRWYNNLKYFLLDNWRRVWVLLLWIGVMAGLFAYKYVQYKNKAAFNVMGHCVCVAKGAAEVLKLNMALILLPVCRNTITWLRNKTKLGGAVPFDDNINFHKVVAGAIAVGVGIHVLAHMTCDFPR

SEQ ID NO: 172 - protein, 276 aa, Capra hircus
TLDILSDNQKGIAFADHGAHWQLHRKLVLNAFALFKDGNLKLEKIINQEANVLCDFLATQHGQSIDLSEPLSLAVTNIISFICFNFSFKNEDPALKAIQNVNDGILEVLSKEILLDIFPALKIFPSKAMEKMKGCVETRNELLNEILEKCQENFTSDSITNLLHILMQAKVNADNNNAGPDQDSKLLSNRHMLATIADIFGAGVETTTSVIKWIVAYLLHHPSLKKRIQDSIDQNIGFNRTPTISDRNCLVLLEATIREVLRIRPVAPMLIPHKAI

SEQ ID NO: 173 - protein, 251 aa, Sus scrofa
ITAVIVNRKEHKLKKGAGYHLDLFWVAILMVVCSFMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDSDDSDCPYSEKVPSIKIPMDI

SEQ ID NO: 174 - protein, 76 aa, Solanum tuberosum
PEADVWTAGVILYILLSGVPPFWAETQQGIFDAVLKGHIDFDSDPWPLLSESAKDLIRKMLCMRPSERLTAHEVLC

SEQ ID NO: 175 - protein, 101 aa, Sus scrofa
CLKYMAKSSEITQDLELVTVEDLVVGIYQQKFLKEPSKTWVRSLLDVAMWDYSSNTRCKWHEENDILFCALAVCRKIAYCISNSLATLLGIQLTEAHVPLQ

SEQ ID NO: 176 - protein, 201 aa, Sus scrofa
KELVHMISWAKKIPGFMELSLYDQVRLLESCWLEVLMVGLMWRSIDHPGKLIFAPDLVLDRDEGKCVEGILEIFDMLLATTSRFRELKLQHKEYLCVKAMILLNSSMYPSAAAQEAESSRKLTHLLNAVTDALVWVIARSGISSQQQSVRLANLLMLLSHVRHASNKGTEHLLNMKCKNVVPVYDLLLEMLNAHTLRGNKS

SEQ ID NO: 177 - protein, 76 aa, Sus scrofa
VCKEKIGWRNDSLHLLVFVSDADSHFGMDSKLAGIVIPNDGLCHLDSKNEYSMSTVLEYPTIGQLIDKLVQNNVLL

SEQ ID NO: 178 - protein, 101 aa, Malus domestica
LNEALKPIGISDWNSLFWIAHPGGPAILDQVEAKLALKPEKLEATRQVLSDYGNMSSACVLFILDEVRRKSAEKGLETTGEGLEWGVLFGFGPGLTVETVV

SEQ ID NO: 179 - protein, 126 aa, Solanum tuberosum
NFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVI

SEQ ID NO: 180 - protein, 76 aa, Sus scrofa
MEDRRESELKTFCSKNILVILGFSSIIAVIALLALGLTQNKPLPENVKFGIVLDAGSSHTSLYIYKWPAEKENDTG

SEQ ID NO: 181 - protein, 126 aa, Solanum tuberosum
ELELLTRMNGLTVDMMPEIDRFYITLQFELAKAMSPCIIWIPNIHDLDVNESNDLSLGLLVNHLSRDCERCSTRNILVIASTHIPQKVDPALIAPNKLNTCIKIRRLLIPQQRKHFFTLSYTRGFH

SEQ ID NO: 182 - protein, 101 aa, Solanum tuberosum
VLAEAIVKGLGSTRMIRGSQLYHRVWNGLWPLDRRCIGECYSFGMETLLKLDLKGTRRLFDAFFDLDPKYWQGFLSSRLSVKELAILSLCLFGHGSNLTRL

SEQ ID NO: 183 - protein, 251 aa, Capra hircus
NLEYLDLSYNRLSNLSSSWFRSLYALKFLNLLGNVYKTLGETSLFSHLPNLRTLKVGNSNSFTEIHEKDFTGLIFLEELEISAQNLQIYVPKSLKSIQNISHLILHLKQPVLLVDILVDIVSSLDCLELRDTNLHTFHFSEASISEMNTSVKKLIFRNVQFTDESFVEVVKLFNYVSGILEVEFDDCTHDGIGDFRALSLDRIRHLGNVETLTIRKLHIPQFFLFHDLSSIYPLTGKVKRVTIESSKVFLV

SEQ ID NO: 184 - protein, 176 aa, Solanum tuberosum
ILALARPDPKKNLTTLVKAFGECRPLRDLANLTLIMGNRDNIDEMSSTNSALLLSILKMIDKYDLYGQVAYPKHHKQSDVPDIYRLAAKTKGVFINPAFIEPFGLTLIEAAAYGLPMVATKNGGPVDIHRVLDNGLLVDPHDQQAIADALLKLVADKQLWAKCRANGLKNIHLFSW

SEQ ID NO: 185 - protein, 251 aa, Sus scrofa
AGSGGGSGWGSGAGEEVEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPEPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTV

SEQ ID NO: 186 - protein, 151 aa, Solanum tuberosum
FGFDTACKIYAEMIGNVMIDARSTGKYYHFVRLMGRAASHITLECALQTHPNVTLIGEEVFAKKLTLKNVTDYIADVVCKRAESGYNYGVILIPEGLIDFIPEVQQLIAELNEILAHDVVDEAGVWKKKLTPQCLELFELLPLAIQEQLLL

SEQ ID NO: 187 - protein, 201 aa, Capra hircus
DRIRHLGNVETLTIRKLHIPQFFLFHDLSSIYPLTGKVKRVTIESSKVFLVPCLLSQHLKSLEYLDLSENLMSEETLKNSACKDAWPFLQTLVLRQNRLKSLEKTGELLLTLKNLNNLDISKNNFLSMPETCQWPGKMKQLNLSSTRIHSLTQCLPQTLEILDVSNNNLDSFSLILPQLKELYISRNKLKTLPDASFLPVL

SEQ ID NO: 188 - protein, 101 aa, Sus scrofa
IHGLLPPCFISQDIQVLRVIKNFERLNSDFDRYLLLMDLQDRNEKLFYKVLMSDIEKFMPIVYTPTVGLACQQYSLAFRKPRGLFISIHDRGHVASVLNAW

SEQ ID NO: 189 - protein, 76 aa, Sus scrofa
VSTSHLLILDDSVEMEIRPRFPLFGGWKTHYIVGYNLPSYEYLYNLGDQYALKMRLVDHVFDEQVIDSLTVKIILP

SEQ ID NO: 190 - protein, 176 aa, Sus scrofa
KLRLVEIAQVPKPHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTV

SEQ ID NO: 191 - protein, 151 aa, Solanum tuberosum
KWAFETLDRYRKKFCMFNDDIQGTAGVALAGLLGTVRAQGRPLTDFANQKIVVVGAGSAGLGVLKMALQAVSRMTGPSADPHFFLLDKNGLITKDRKDIDPAALPFAKAHHEIEGLGLQEGAGLAEVVKKVKPHVLLGLSGVGGIFHEEVL

SEQ ID NO: 192 - protein, 276 aa, Capra hircus
MWVLLGVFLLTLAYLFWPKTKHSAAKYPRSLPSLPLVGSLLFLPRRGQQHENFFKLQEKYGPIYSFRLGSKTTVMIGHHQLAREVLLKKGKEFSGRPKVATLDILSDNQKGIAFADHGAHWQLHRKLVLNAFALFKDGNLKLEKIINQEANVLCDFLATQHGQSIDLSEPLSLAVTNIISFICFNFSFKNEDPALKAIQNVNDGILEVLSKEILLDIFPALKIFPSKAMEKMKGCVETRNELLNEILEKCQENFTSDSITNLLHILMQAKVNADNN

SEQ ID NO: 193 - protein, 201 aa, Sus scrofa
SKFGKQHIENLFNDLQDGRRLLDLLEGLTGQKLPKEKGSTRVHALNNVNKALQVLQKNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIAKYQLGIEKLLDPEDVATTYPDKKSILM

SEQ ID NO: 194 - protein, 101 aa, Sus scrofa
AVTHLLQELRAKWPGPTPGLTTIEAPTSQTVTLVTQPTVTKETAISKPEMPSSLLLEVPALADFNRAWTELTDWLSLLDRVIKSQRVMVGDLEDINEMIIK

SEQ ID NO: 195 - protein, 151 aa, Malus domestica
RSIHSIFPFLEDKFPHLNYVSDVLIPYPIHLEILVQTLRYWVKDPSSLHLLRLFLHEYSNWNSLITPKKIIFSKSNPRLFLLLYNSHVCEYESILLFLRNQSSHLRLTSSGIFFERIHFYEKKKDPVEEVFVNDFPAAILWFFKDPFMHYV

SEQ ID NO: 196 - protein, 101 aa, Sus scrofa
IPNDFSMKDTTMWIFVAILSAVVCLIMIWAVALKGYSMVACILPPVPGPKIKGFDTHLLEKGKSEELLSALGCQDFPPTSDCEDLLVEFLEVDDSEDQQLM

SEQ ID NO: 197 - protein, 76 aa, Sus scrofa
PKPFTEEVLWNVWLEFSIKIKDLPKGALLNLQIYCGKAPALSGKTSAEMPSPESKGKAQLLYYVNLLLIDHRFLLR

SEQ ID NO: 198 - protein, 276 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQL

SEQ ID NO: 199 - protein, 76 aa, Malus domestica
YLDLYLVHYPMPTKHNAIGKTASLLGEDKVLDIDVTISLQQTWEGMEKTVSLGLVRSIGLSNYELFLTRDCLAYSK

SEQ ID NO: 200 - protein, 101 aa, Sus scrofa
KLDAVYLNKNKYLTVIDKDAFGGVFSGPTLLDVSYTSVTALPPKGLEHLKELIARNTWTLKKLPLSLSFLHLTRADLSYPSHCCAFKNQKKIRGILESLMC

SEQ ID NO: 201 - protein, 76 aa, Sus scrofa
FANGTIRTSELRLSMQKSMQSHAAVFRVGSVLQEGCEKILRLYGDLQHLKTFDRGMVWNTDLVETLELQNLMLCAL

SEQ ID NO: 202 - protein, 76 aa, Malus domestica
ALLVEAEWYNKSHIPTLEEYLRNGCISSSVSVLLVHSFFSITHEGTKEMADFLHKNEDLLYNISLIVRLNNDLGTS

SEQ ID NO: 203 - protein, 226 aa, Sus scrofa
TLDILSDNQKGIAFADHGTSWQLHRKLALSTFSLFKGGNLKLENIINQEIKVLCDFLATRNGESIDLAQPLSLAMTNIVSFICFNFSFKKGDPALQAIVNFNDGILDAVGKEILYDMFPGIRILPSQTLENMKQCVRMRNELLREILENRKENYSRNSITNLLDIMIQAKTNAESNTGGPDHNLKLLSDRHMLATVADIFGAGVETSASVVKWIVAFLLHYPLLRK

SEQ ID NO: 204 - protein, 101 aa, Sus scrofa
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHL

SEQ ID NO: 205 - protein, 126 aa, Sus scrofa
DFFINGNIKVFPDPPPPVRPPPVEKEENGTLTIEQLDNLRDQFLDIAPKGVIGNKAFADILLDLVTLNLGTNNFPSSWMHLTQPELQELASLLVINSELVDWRKFLLVAALPWPIPLEEELLETLQ

SEQ ID NO: 206 - protein, 201 aa, Sus scrofa
VINVHEAERNFTVACQHRSNSEIICCTTPSLQQLNLQLPLKTKAFFMLDGIHSKYFDLIYVHNPVFKPFEKPVMISIGNENVLEIKGNDIDPEAVKGEVLKVGNKSCENIHSHSEAVLCTVPNDLLKLNSELNIEWKQAISSTVLGKVIVQPDQNFTGLIVGVVSISIILLLLLGLFLWLKKRKQIKDLGSELVRYDARVH

SEQ ID NO: 207 - protein, 76 aa, Capsicum annuum
VDTINYPIHMKNLSLKELKQLADELRSDTIFNVSKTGGHLGSSLGVVELTVALHYVFNAPQDRILWDVGHQSYPHK

SEQ ID NO: 208 - protein, 176 aa, Sus scrofa
VDKTTTVQVPMMHQMEQYYHLVDTELNCTVLQMDYSKNALALFVLPNEGQMEWVEGAMSSKILKKWNRLLQKGWIDLFVPKFSMSATYDLGDILLKMGIQDAFADNADFSGLTKDNGLKLSNAAHKAVLNIGEKGTEAIPEVTFLNQPKITLLHPIIQFDRSFLLLILEKSTRSIL

SEQ ID NO: 209 - protein, 126 aa, Sus scrofa
IVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQV

SEQ ID NO: 210 - protein, 201 aa, Malus domestica
GARVLVVCSEITAVTFRGPSDTHLDSLVGQALFGDGAAAVIIGADPVPEVEKPLFELVSAAQTVLPDSDGAIDGHLREVGLTFHLLKDVPGLISKNIEKSLNEALKPIGISDWNSLFWIAHPGGPAILDQVEAKLALKPEKLEATRQVLSDYGNMSSACVLFILDEVRRKSAEKGLETTGEGLEWGVLFGFGPGLTVETVV

SEQ ID NO: 211 - protein, 101 aa, Sus scrofa
QLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVL

SEQ ID NO: 212 - protein, 101 aa, Agaricus bisporus
ILLSNFFAQPEALAFGKTEEEVRKELGQNASEALVKSKVFEGNRPSSSLMFDKLDPATLGALIALYEHKIFVQGVVWGINSFDQMGVELGKVLAKQILAQL

SEQ ID NO: 213 - protein, 276 aa, Malus domestica
EYIYALAHDHGLNRSILLDNVGYDTKYSLLIIKRLISRMYQQNHLIISANDSNQNKFFGYNKNLYSQMMSEGFAVIVEIPFSRRLVSSLEATEIVKSYNLRSIHSIFPFLEDKFPHLNYVSDVLIPYPIHLEILVQTLRYWVKDPSSLHLLRLFLHEYSNWNSLITPKKIIFSKSNPRLFLLLYNSHVCEYESILLFLRNQSSHLRLTSSGIFFERIHFYEKKKDPVEEVFVNDFPAAILWFFKDPFMHYVRYQGKSILSSKDTPLLMNKWKYYLV

SEQ ID NO: 214 - protein, 76 aa, Sus scrofa
LIERATQPEEILALLGGGHCLHQNRAALMVIQLSRLLSEKPKDKALLIKDARFQHLLRLVNSQINAVWHGTLVKLL

SEQ ID NO: 215 - protein, 126 aa, Sus scrofa
ILPLPGQSVDQLCVDLKHSQGPVKLLSDPGQGVEVTGHYEREKARFSWIEVTFKHPPLQVRASLEHIVVIRNRQSSAYKWKETLYSVMPGLKITMDKAGLLLLSSPNRVTIGLLSWDGPGKGLRLL

SEQ ID NO: 216 - protein, 201 aa, Sus scrofa
TTALLFTPVTIRLCEVLNLDPRQVLIAEVIFTNIGGAATAIGDPPNVIIVSNQELRKMGLDFAGFTAHMFAGICFVLLFSFPLLRLLYWNRKLYNKEPSEIVELKHEIHVWRLTAQRISPASREETAVRGLLLEKVLSLERLLARRLHSFHRQISQEDKNWETNIQELQKKHRISDRTLLTKCVTVLGLVIFMFFLNSFVP

SEQ ID NO: 217 - protein, 176 aa, Sus scrofa
MELGAAARAWSLLWLLLPLLGLVGASGPRTLVLLDNLNLRETHSLFFRSLKDRGFVLTFKTADDPSLSLIKYGEFLYDNLIVFSPSVEDFGGNINVETISTFIDGGGSVLVAASSDIGDPLRELGSECGIEFDEEKTAVIDHHNYDVSDLAQHTLIVADTENLLKAPTIVGKSSLN

SEQ ID NO: 218 - protein, 76 aa, Capsicum annuum
LAAASVLESRGLQVTVADARFCKPLDRALIRSLAKSHEVLVTVEKGSIGGFGSHVVQFMALDGLLDGKLKWRPIVL

SEQ ID NO: 219 - protein, 76 aa, Sus scrofa
VLSWQFSSVTKRGLNVDQLNMLGEKLLGPTAGPDGLIPWTRFCKENINDKNFPFWLWIESILELIKKHLLSLWNDG

SEQ ID NO: 220 - protein, 276 aa, Sus scrofa
MWVLLVFFLLTLTYLFWPKTKGSGAKYPRSLPVLPVVGSLPFLPRRGHQHMNFFKLQDKYGPIFSFRLGSKTTVVIGDHQLAKEVLLKKGKEFSGRPRVMTLDILSDNQKGIAFADHGTSWQLHRKLALSTFSLFKGGNLKLENIINQEIKVLCDFLATRNGESIDLAQPLSLAMTNIVSFICFNFSFKKGDPALQAIVNFNDGILDAVGKEILYDMFPGIRILPSQTLENMKQCVRMRNELLREILENRKENYSRNSITNLLDIMIQAKTNAESN

SEQ ID NO: 221 - protein, 76 aa, Sus scrofa
HKIQSEKMVVSLETRIAQEKLCRLSLSHQTITKMNQIAKKLWTRCLTHSQGVFRLPIAAAQILPALLGKTYLDVTK

SEQ ID NO: 222 - protein, 76 aa, Sus scrofa
SLIHQLVSAEDLEPLGTPMLIEDGYAVTQAELFALLCRLADELLFRQIAWIKKLPFFCELSIKDYTCLLSSTWQEL

SEQ ID NO: 223 - protein, 226 aa, Prunus persica
MNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSGSGINPQDIPKLFTKFAQTQSLATRNSGGSGLGLAICKRFVNLMEGHIWIESEGPGKG

SEQ ID NO: 224 - protein, 151 aa, Prunus persica
EYIYALAHDHGLNRSILLDNVGYDNKSSLLIIKRLISRMYKHNHFFISANASNQKKKLGYNKNLYSQKISEGFTVIVEISFSLRLVSSLEATETVKSYNLRSIHSIFPFLEDKFPHLNYVSDVLIPYPIHLEILVQTLRYWVKDASSLHLL

SEQ ID NO: 225 - protein, 126 aa, Sus scrofa
IFHIMKHNHYTCRFGSKLGLECIGMHEKGIMFNNNPALWKAVRPFFTKALSGPGLVRMVTVCADSITKHLDKLEEVRNDLGYVDVLTLMRRIMLDTSNNLFLGIPLDESALVHKVQGYFDAWQALL

SEQ ID NO: 226 - protein, 126 aa, Sus scrofa
PPPPPPTLLPSRPLPPLPPPSLKKKRDHNAGLCLLVMFFMVLVALVGLGLGMFQLFHLQKELTELRESASQRHTESSLEKQIGHPNLPSEKKELRKVAHLTGKPNSRSIPLEWEDTYGIALVSGVK

SEQ ID NO: 227 - protein, 251 aa, Sus scrofa
TLERDPDVLDTWFSSALFPFSALGWPQETPDLARFYPLSLLETGSDLLLFWVGRMVMLGTQLTGQLPFSKVLLHSMVRDRQGRKMSKSLGNVLDPRDIINGVELQVLQEKLRDGNLDPAELAIAAAAQKKDFPHGIPECGTDALRFTLCSHGVLGGDLHLSVSEVLSFRHFCNKIWNALRFILNALGEKFIPQPLEELCPTSPMDAWILSCLARTAQECERGFLTRELALVTHALHHFWLHNLCDVYLEAV

SEQ ID NO: 228 - protein, 76 aa, Sus scrofa
MKTPWKVLLGLLGIAALVTVITVPVVLLNKGTDDAAADSRRTYTLTDYLKSTFRVKFYTLQWISDHEYLYKQENNI

SEQ ID NO: 229 - protein, 251 aa, Sus scrofa
ELLKFLQMNGYAVTRGLKDMELDTSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSL

SEQ ID NO: 230 - protein, 176 aa, Sus scrofa
VPLHNLSLDLSLNPLNFIEPGAFNKIRLNGLTLRSNFNSSDVMKTCIQGLAGSKVNQLVLGEFKNERNLESFDKSVLEELCNLTLEQFRIAHFGEFPDDVSDLFNCLANASVISLLSLNLHGLEALPNDFRWQHLEVVNCKLQQFPALKFNSLKKFVFKDNKHMHTFTEINLPNLQ

SEQ ID NO: 231 - protein, 101 aa, Sus scrofa
MKKTQTWIITCIYLQLLLFNPLVRTQGICRNRVTDDVKDVTKLVANLPKDYKITLKYVPGMDVLPSHCWISEMVEQLSVSLTDLLDKFSNISEGLSNYSII

SEQ ID NO: 232 - protein, 126 aa, Sus scrofa
KVGNKSCENIHSHSEAVLCTVPNDLLKLNSELNIEWKQAISSTVLGKVIVQPDQNFTGLIVGVVSISIILLLLLGLFLWLKKRKQIKDLGSELVRYDARVHTPHLDRLVSARSVSPTTEMVSSEPV

SEQ ID NO: 233 - protein, 76 aa, Sus scrofa
LWLVSDYHEHGSLFDYLNRYTVTVEGMIKLALSTASGLAHLHMEIVGTQGKPAIAHRDLKSKNILVKKNGTCCIAD

SEQ ID NO: 234 - protein, 126 aa, Sus scrofa
SDTFSHLSRLEGLVLKDSSLYNLDTRWFRGLDRLQVLDLSENFLYDCITKTTAFQGLARLRSLNLSFNYHKKVSFAHLHLAPSFGHLRSLKELDMHGIFFRSLSETTLQPLVQLPMLQTLRLQMNF

SEQ ID NO: 235 - protein, 226 aa, Solanum tuberosum
EVPKLGKEAAQKAIKEWGQPKSKITHVVFCTTSGVDMPGADYQLTKLLGLRPSVKRLMMYQQGCFAGGTVIRLAKDLAENNKGARVLVVCSEITAVTFSGPSDTHLDSMVGQALFGDGAAAMIIGSDPLPEVERPLFELVSAAQTLLPDSEGAIDGHLREVGLTFHLLKDVPGLISKNIEKSLIEAFQPLGISDWNSIFWIAHPGGPAILDQVELKLGLKPEKLQA

SEQ ID NO: 236 - protein, 151 aa, Sus scrofa
ELLKFLQMNGYAVTRGLKDMELDTSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSL

SEQ ID NO: 237 - protein, 76 aa, Sus scrofa
IVPPASTWVFPTLGIMHYNKQATENAKDEVRRVLGLLDAHLKTRTFLVGERVTLADITVVCTLLWLYKQVLEPSFR

SEQ ID NO: 238 - protein, 276 aa, Malus domestica
AEQRLMVETILRSSNLLATLINDVLDLSRLEDGSLQLEIATFNLHSVFREVHNMIKPVASIKRLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQALATRNSGGSGLGLAICKRFVNLMEGHIWIESEGLGKGCTATFIVKLGFPERSNESKLPFAPKLQANHVQTNFPGLKVLVMDDNGVSRSVTKGLLAHLGCDVTAVSLIDELLH

SEQ ID NO: 239 - protein, 126 aa, Sus scrofa
MVRAKSWTLKKHFVGYPTPSNFELKTVELPPLKNGEVLLEALFLTVDPYMRIAARKLKEGDMMMGEQVARVIESKNAAFPTGTIVVALLGWTTHSISDGKNLERLLAEWPDTLPLSLTLGTVGMPG

SEQ ID NO: 240 - protein, 201 aa, Sus scrofa
IVELKHEIHVWRLTAQRISPASREETAVRGLLLEKVLSLERLLARRLHSFHRQISQEDKNWETNIQELQKKHRISDRTLLTKCVTVLGLVIFMFFLNSFVPGVHLDLGWIAILGAIWLLILADIHDFEIILHRVEWATLLFFAALFILMEALAHLHLIEYVGEQTALLIKMVPEDQRLAAAIIVVVWVSAIASSLIDNIPF

SEQ ID NO: 241 - protein, 76 aa, Sus scrofa
MRILKPCLRSTCIQCYLCLLLNSHFLTEDGIHVFILGCISAGLPKTEATWQHVISDLKKIEDLIRSIHMDATLYTE

SEQ ID NO: 242 - protein, 76 aa, Salmo salar
LLHLAAKSFSHSFSALAKFHEILKALTDCDEGKLHILRVVYEVWKNHPQMVSVLVDKLIRTQIVDCAAVANWLFSP

SEQ ID NO: 243 - protein, 76 aa, Sus scrofa
DRYLLKNGHRIILLAEGRLVNLGCAMGHPSFVMSNSFTNQVLAQIELWTHPDKYPVGVHFLPKKLDEAVAEAHLGK

SEQ ID NO: 244 - protein, 126 aa, Sus scrofa
MSHGKMPLVLSLVLILCGLFNSISCEKQQTSPKTITPVSFKRIAALSQKMEANYKAFAQELFKTLLIEDPRKNMIFSPVSISISLATLSLGLRSATRTNAIDVLERDLRNLRVWDKHQALQHLVEM

SEQ ID NO: 245 - protein, 76 aa, Meleagris gallopavo
VYLFVVNHPHQKSTVELFKFMEEDNSLLHLKTIRHDLLTSVNDVVAVGPDSFYATNDHYFYDFILMFLEMYLGLTW

SEQ ID NO: 246 - protein, 76 aa, Sus scrofa
KENYSRNSITNLLDIMIQAKTNAESNTGGPDHNLKLLSDRHMLATVADIFGAGVETSASVVKWIVAFLLHYPLLRK

SEQ ID NO: 247 - protein, 101 aa, Solanum tuberosum
GHNVIWGLHDALKVHNPKNILLGFLGGSEGLFAQKTLEITDDVLATYKNQGGYDMLGRTKDQIRTTEQVNAAMAACKALKLDGLVIIGGVTSNTDAAHLAE

SEQ ID NO: 248 - protein, 201 aa, Solanum tuberosum
EVPKLGKEAAQKAIKEWGQPKSKITHLVFCTTSGVDMPGCDYQLAKLLGLRPSVKRLMMYQQGCFAGGTVLRLAKDLAENNKGARVLVVCSEITAVTFRGPSESHLDSLVGQALFGDGAAAIIMGSDPIIGVERPLFELVSAAQTLVPDSEGAIDGHLREVGLTFHLLKDVPGLISKNIEKSLLEAFQPLGISDWNSLFWI

SEQ ID NO: 249 - protein, 101 aa, Sus scrofa
TLERDPDVLDTWFSSALFPFSALGWPQETPDLARFYPLSLLETGSDLLLFWVGRMVMLGTQLTGQLPFSKVLLHSMVRDRQGRKMSKSLGNVLDPRDIING

SEQ ID NO: 250 - protein, 76 aa, Sus scrofa
TLDILSDNQKGIAFADHGTSWQLHRKLALSTFSLFKGGNLKLENIINQEIKVLCDFLATRNGESIDLAQPLSLAMT

SEQ ID NO: 251 - protein, 76 aa, Sus scrofa
AIGLSVTDLVGSILKNLRRVHPVSTMVKGLYGIKEEIFLSIPCVLGRNGVSDIVKVNLNAEEEALFKKSANTLWNV

SEQ ID NO: 252 - protein, 276 aa, Sus scrofa
MQRSPLEKASIFSKLFFSWTRPILRKGYRQRLELSDIYHISSSDSADNLSEKLEREWDRELASKKNPKLINALRRCFFWRFMFYGIILYLGEVTKAVQPLLLGRIIASYDPDNKAERSIAIYLGVGLCLLFIVRTLLLHPAIFGPHHIGMQMRIAMFSLIYKKTLKLSSRVLDKISIGQLVSLLSNNLNKFDEGLALAHFVWIAPLQVTLLMGLLWELLQASAFCGLAFLVVLALFQAGLGKMMMKYRDQRAGKINERLVITSEMIENIQSVKAYC

SEQ ID NO: 253 - protein, 176 aa, Sus scrofa
LWDRTFSLFQQLIQSSFVVERQPCMPTHPQRPLVLKTGVQFTVKLRLLVKLQKLNYNLKVKVLFDKDVSERNTVKGFRKFNILGTHTKVMNMEESTNGSLAAEFRHLQLKEQKNAGARTNEGPLIVTEELHSLSFETQLCQPGLVIDLETTSLPVVVISNVSQLPSGWASILWYNM

SEQ ID NO: 254 - protein, 276 aa, Sus scrofa
LWDRTFSLFQQLIQSSFVVERQPCMPTHPQRPLVLKTGVQFTVKLRLLVKLQKLNYNLKVKVLFDKDVSERNTVKGFRKFNILGTHTKVMNMEESTNGSLAAEFRHLQLKEQKNAGARTNEGPLIVTEELHSLSFETQLCQPGLVIDLETTSLPVVVISNVSQLPSGWASILWYNMLVAEPRNLSFFLNPPCARWSQLSEVLSWQFSSVTKRGLNVDQLNMLGEKLLGPTAGPDGLIPWTRFCKENINDKNFPFWLWIESILELIKKHLLSLWNDG

SEQ ID NO: 255 - protein, 126 aa, Sus scrofa
PAKGRPDQPAPFSLLCRMADQTFISIVDWARRCMVFKELEVADQMTLLQNCWSELLVFDHIYRQIQHGKEGSILLVTGQEVELTTVAAQAGSLLHGLVLRAQELVLQLHALQLDRQEFVCLKFLIL

SEQ ID NO: 256 - protein, 151 aa, Sus scrofa
NAVLENISFSISPGQRVGLLGRTGSGKSTLLLAFLRLLNTEGEIQVDGVSWDSITLQQWRKAFGVIPQKVFIFSGTFRKNLDPYGQWNDQEIWKVAEEVGLRSVIEQFPGKLDFVLVDGGCVLSHGHKQLMCLARSVLGKAKILLLDEPSA

SEQ ID NO: 257 - protein, 176 aa, Capra hircus
MWVLLGVFLLTLAYLFWPKTKHSAAKYPRSLPSLPLVGSLLFLPRRGQQHENFFKLQEKYGPIYSFRLGSKTTVMIGHHQLAREVLLKKGKEFSGRPKVATLDILSDNQKGIAFADHGAHWQLHRKLVLNAFALFKDGNLKLEKIINQEANVLCDFLATQHGQSIDLSEPLSLAVT

SEQ ID NO: 258 - protein, 251 aa, Solanum tuberosum
SLCLKKCVEKGQMYRTFQRDSAFSTLSKWNLFQTYMPWFLTSTGYKYLNLIFLDTFSDLLPILSSSQKFVSIFPDIMHGSGISWRILQKKLCLPQWNLISEISSKCLHNLLLSEEMIHRNNESPLISTHLRSPNAREFLYSILFLLLVAGYLVRTHLLFVSRASSELQTEFEKVKSLMIPSSMIELRKLLDRYPTSEPNSFWLKNLFLVALEQLGDSLEEIRGSASGGNMLGPAYGVKSIRSKKKDWNINL

SEQ ID NO: 259 - protein, 126 aa, Sus scrofa
KNIHLTLQVPEIPLHLAYDSKLVFLQEAPKAVITELPPSTTKNQLFLWANTKGSIISAAELDNPQSILLRLDQAPTSPSRCTLEPRKDMGHTLEWKSHTQASVLGCHLEGVTGHKEAHILRVLPGS

SEQ ID NO: 260 - protein, 101 aa, Solanum tuberosum
PSDTHLDSMVGQALFGDGAAAMIIGSDPLPEVERPLFELVSAAQTLLPDSEGAIDGHLREVGLTFHLLKDVPGLISKNIEKSLIEAFQPLGISDWNSIFWI

SEQ ID NO: 261 - protein, 151 aa, Solanum tuberosum
SVRWLQVQTSSGLDLRSELVQELIPEQQDRLKKIKSDMKGSIGNITVDMVLGGMRGMTGLLWKPHYLDPDEGIRFRGLSIPECQKVLPAAKPGGEPLPEGLLWLLLTGKVPSKEQVNSIVSGIAESGIISLIIMYTTIDALPVTAHPMTQF

SEQ ID NO: 262 - protein, 251 aa, Sus scrofa
FYAALIDLLGRCAPEMHLIQAGKGEALRIRAILRSLVPLDDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEECLMALCRYIRPSMLQHLLRRLVFDVPILNEFAKMPLKLLTNHYERCWKYYCLPTGWANFGVTSEEELHLT

SEQ ID NO: 263 - protein, 251 aa, Prunus persica
EYIYALAHDHGLNRSILLDNVGYDNKSSLLIIKRLISRMYKHNHFFISANASNQKKKLGYNKNLYSQKISEGFTVIVEISFSLRLVSSLEATETVKSYNLRSIHSIFPFLEDKFPHLNYVSDVLIPYPIHLEILVQTLRYWVKDASSLHLLRLFLHEYYNWNSLITSNNFFFSKSNPRLFLLLYNSHVCEYEFILLFLRNQSSHLQLTSSGIFFERIHFYEKIKYPVEKVFANDFPASILWFFKDPFMHYV

SEQ ID NO: 264 - protein, 251 aa, Sus scrofa
GEPSEQPEWYVGAPVAYIQQIFVKSSVSPWHKNLLAVDVFRSPLSRAFQLVEEIRNHVLRDSSGTRSLEEVCLQVTDLLPGLRKLRNILPEHGCLLLSPGNFWQNDRERFHADPDIIGTIHQHEPKTLQTSATLKDLLFGVPGKHSGVSLYTRKRLVSYTITLVFQHYHAKFLGSLRARLMLLHPSPNCSLRAESLVHVHFKEEIGIAELIPLVTTYIILFAYIYFSTRKIDMVKSKWGLALAAVVTVLSS

SEQ ID NO: 265 - protein, 151 aa, Sus scrofa
VLATYFVFMTFFPACVSLVLELSRESREGRPIWQLSHFARVLEGEENKPNPVTQRVKIIMSLGLVLVHAHSRWIADPSPQNSTADNSKVSLGLDENVSKRIEPSVSLWQFYLSKMISMDIEQVITLTLALLLAVKYIFFEQAETESTLSLK

SEQ ID NO: 266 - protein, 176 aa, Solanum tuberosum
MAKKKAFTPLFYLASIVFLPWWISFSVNKCLESWVTNWWNTGQSQIVLNNIQEKSLLEKFRELEELLFLDEMIKEYSETHLEEFGIGIHKETIQLITIQNENRMDTILHFSTNIIWFGILSGYSILGKEKLVILNSWAQEFLYNLSDTAKALCLLLVTEFFLGYHSPPGWEFAIRS

SEQ ID NO: 267 - protein, 176 aa, Sus scrofa
MSLLLVSLLAFLTLGSGCHHRICHCSNGVFLCQESKVTEIPPDLPRNAVELRFVLTKLRVIPKGAFSGFGDLEKIEISQNDVLEVIEANVFSNLPKLHEIRIEKANNLLYIDPDAFQNLPNLRYLLISNTGVKHLPAVHKIQSLQKVLLDIQDNINIHTVERNSFVGLSFESMILW

SEQ ID NO: 268 - protein, 76 aa, Meleagris gallopavo
GDIAGKLQTGRSRNEQVVTDLKLLLKSSISVISTHLLQLIKTLVERAAIEIDIIMPGYTHLQKALPIRWSQFLLSH

SEQ ID NO: 269 - protein, 251 aa, Malus domestica
RSIHSIFPFLEDKFPHLNYVSDVLIPYPIHLEILVQTLRYWVKDPSSLHLLRLFLHEYSNWNSLITPKKIIFSKSNPRLFLLLYNSHVCEYESILLFLRNQSSHLRLTSSGIFFERIHFYEKKKDPVEEVFVNDFPAAILWFFKDPFMHYVRYQGKSILSSKDTPLLMNKWKYYLVNLWQCHSYVWSQPGRIYINQLSKHSLDFLGYFSSMRPNLSVVRGQMLENSFIMDNAMKKLDTLVPIIPLIGSLAK

SEQ ID NO: 270 - protein, 76 aa, Sus scrofa
LTFLPSDDDFYDCKVEHWGLDKPLLKHWEPEIPAPMSELTETVVCALGLIVGLVGIVVGTVFIIQGLRSGGPSRHQ

SEQ ID NO: 271 - protein, 76 aa, Solanum tuberosum
EPFGLTLIEAAAYGLPMVATKNGGPVDIHRVLDNGLLVDPHDQQAIADALLKLVADKQLWAKCRANGLKNIHLFSW

SEQ ID NO: 272 - protein, 201 aa, Sus scrofa
APETVHTLKGGRAVAEDTVIILVDLFNDHYFMDNVTAPDYMKNVLVLTLPPENSVSNSSFSKDLSLVKNDFTLAYMNGVLLFGHMLKIFLEKREDVTTSKFAHAFRNITFEGHMGPVTLDNCGDIDNTMFLLYTSVDTSKYKVLLTYDTRKNYTNPVDKSPTFIWKNHKLPNDIPGRGPQILMIAVFTLTGTIVLLLLIAL

SEQ ID NO: 273 - protein, 276 aa, Sus scrofa
VPLHNLSLDLSLNPLNFIEPGAFNKIRLNGLTLRSNFNSSDVMKTCIQGLAGSKVNQLVLGEFKNERNLESFDKSVLEELCNLTLEQFRIAHFGEFPDDVSDLFNCLANASVISLLSLNLHGLEALPNDFRWQHLEVVNCKLQQFPALKFNSLKKFVFKDNKHMHTFTEINLPNLQFLDLSGNHLSFKGCCSHNEFGTTKLKHLDLSFNEIITMKSNFMGLEQLEYLDFQHSSLKQANDFSIFLSLRNLHYLDISYTNIHVVFRGIFAGLVSLQTL

SEQ ID NO: 274 - protein, 126 aa, Sus scrofa
GPNGGLLYCMEYLEANLDWLRAKLDPLRGHYFLFDCPGQVELCTHHGALRSIFSQMTQWDLRLTAVHLVDSHYCTDPAKFISVLCTSLATMLHVELPHVNLLSKMDLIEHYGKLAFNLDYYTEVLD

SEQ ID NO: 275 - protein, 76 aa, Sus scrofa
YLTFLPSDDDFYDCKVEHWGLDKPLLKHWEPEIPAPMSELTETVVCALGLIVGLVGIVVGTVFIIQGLRSGGPSRH

SEQ ID NO: 276 - protein, 76 aa, Sus scrofa
IIKHIAKKNGKSLPASLQSLRPDEEVGEKLKPSFLDLVRTPQIRKHTLILMYNWFTSAVLYQGLVMHMGLAGSNLY

SEQ ID NO: 277 - protein, 101 aa, Sus scrofa
MQLKPMEINPEMLNKVLTRLGVAGHWRFADVLGLEEESLGSVPAPACALLLLFPLTAQHENFRKKQIEELKGQEVSPKVYFMKQTIGNSCGTIGLIHAVAN

SEQ ID NO: 278 - protein, 101 aa, Capra hircus
SELKPGELRLLEVDNRVVLPMEMTIRMLISSEDVLHSWAVPSLGLKTDAIPGRLNQTTLMSTRPGLFYGQCSEICGSNHSFMPIVLELVPLKYFEKWSASM

SEQ ID NO: 279 - protein, 251 aa, Capra hircus
MPRALWTAWVWAVIILSMEGASHQASSLSCDPTGVCDGHSRSLNSIPSGLTDGVKSLDLSNNEITYVSNRDLQRCVNLKTLRLGANEIHTVEEDSFFHLRNLEYLDLSYNRLSNLSSSWFRSLYALKFLNLLGNVYKTLGETSLFSHLPNLRTLKVGNSNSFTEIHEKDFTGLIFLEELEISAQNLQIYVPKSLKSIQNISHLILHLKQPVLLVDILVDIVSSLDCLELRDTNLHTFHFSEASISEMNTSV

SEQ ID NO: 280 - protein, 126 aa, Sus scrofa
HYYVFFEEQEDEIIGFGQELKNPQEETLQAFDSHYDYTVCGGSEDMVCTPKSDEFNPCEDIMGYRFLRIVVWFVSLLALLGNVFVLVILLTSHYKLTVPRFLMCNLAFADFCMGMYLLLIASVDLY

SEQ ID NO: 281 - protein, 276 aa, Sus scrofa
EDSGEPLERRLSLVPDSEHGEAILPRSNVINAGPTFQGRRRQSVLNLMTRSSVNQGQSIHRKTATSTRKMSLVPQANLTEIDIYSRRLSQDTGLEISEEINEEDLRECFFDDVESIPTVTTWNTYLRYVTVHKSLIFVLIWCLVVFLAEVAACLVVLCLLKKTSPQDKGNSTKGANNSYAVIITSTSAYYVFYIYVGVADGLLALGLFRGLPLVHTLITVSKILHRKMLHSVLQAPMSTLNTLKAGGILNRFSKDIAVLDDLLPLTIFDFIQLLLI

SEQ ID NO: 282 - protein, 76 aa, Sus scrofa
RIEKANNLLYIDPDAFQNLPNLRYLLISNTGVKHLPAVHKIQSLQKVLLDIQDNINIHTVERNSFVGLSFESMILW

SEQ ID NO: 283 - protein, 76 aa, Meleagris gallopavo
VPLLVMIFVYVRVFAVATRHVQLIGKDKVRFLQENPSLSSRGGRWRRPSRLLAIKEHKALKTLGIIMGTFTLCWLP

SEQ ID NO: 284 - protein, 126 aa, Sus scrofa
MRMLLHLSLLGLGAAYVSAIAVENTMNRLVAETLTLLSIHRTLLIGDGNLMISTPVHTNHQLCIEEVFQGIDTLKNQTARGDAVEKLFQNLSLIKEYIDRQKKNCGGERWRVTQFLDYLQVFLGVI

SEQ ID NO: 285 - protein, 76 aa, Solanum tuberosum
AMVVVIQIFMAKELFNLLRRAHEDRHLPGFRLLNWHFFFTAMLFVYGRMLSQRLVNTVTLDKFLYKLVGRFVKYHM

SEQ ID NO: 286 - protein, 176 aa, Sus scrofa
MWVLLVFFLLTLTYLFWPKTKGSGAKYPRSLPVLPVVGSLPFLPRRGHQHMNFFKLQDKYGPIFSFRLGSKTTVVIGDHQLAKEVLLKKGKEFSGRPRVMTLDILSDNQKGIAFADHGTSWQLHRKLALSTFSLFKGGNLKLENIINQEIKVLCDFLATRNGESIDLAQPLSLAMT

SEQ ID NO: 287 - protein, 126 aa, Sus scrofa
NFWQNDRERFHADPDIIGTIHQHEPKTLQTSATLKDLLFGVPGKHSGVSLYTRKRLVSYTITLVFQHYHAKFLGSLRARLMLLHPSPNCSLRAESLVHVHFKEEIGIAELIPLVTTYIILFAYIYF

SEQ ID NO: 288 - protein, 101 aa, Capra hircus
MKKTQTWIITCIYLQLLLFNPLVHSQGICRNRVTDDVKDVTKLVANLPKDYMITLKYVPGMDVLPSHCWISEMVEQLSVSLTDLLDKFSNISEGLSNYSII

SEQ ID NO: 289 - protein, 276 aa, Sus scrofa
LDLSKCQLEQVSQRAFHSLPRLQVLNMSHNRLLFLDTLPYKPLHSLRILDCSYNLIVASKEQELQHLPRSLAFLNLTKNDFSCACEHQTFLQWVKDQKQLLVGAEQMVCTQPLEMQDLPVLSFRNATCQISEAVISASVLTFLLVSVAGILVYKFYFHLLLFVGCKKYGRGESTYDAFVIYSSQDEDWVRNELVKNLEEGVPPFHLCLHYRDFIPGVAIAANIIQEGFHKSRKVIVVVSQHFIQSRWCIFEYEIAQTWQFLRSHAGIIFIVLQKLE

SEQ ID NO: 290 - protein, 101 aa, Solanum tuberosum
TLLGKRVDYSGRSVIVVGPSLSLHRCGLPREIAIELFQTFVIRGLIRQHLASNIGVAKSKIREKEPIVWEILQEVMQGHPVLLNRAPTLHRLGIQAFQPVL

SEQ ID NO: 291 - protein, 151 aa, Capra hircus
NLEYLDLSYNRLSNLSSSWFRSLYALKFLNLLGNVYKTLGETSLFSHLPNLRTLKVGNSNSFTEIHEKDFTGLIFLEELEISAQNLQIYVPKSLKSIQNISHLILHLKQPVLLVDILVDIVSSLDCLELRDTNLHTFHFSEASISEMNTSV

SEQ ID NO: 292 - protein, 76 aa, Sus scrofa
DPMVDFLDSWVHIIPVWILDNILDQLVFPKLQKEVENWNPLTDTVPIHSWIHPWLPLMQARLEPLYSPIRSKLASA

SEQ ID NO: 293 - protein, 76 aa, Sus scrofa
TWHYFLHRLLHHKRIYKYIHKIHHEFQAPFGMEAEYAHPLETLILGTGFFIGIMLLCDHVILLWAWVTVRLIETID

SEQ ID NO: 294 - protein, 126 aa, Sus scrofa
QTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLL

SEQ ID NO: 295 - protein, 151 aa, Sus scrofa
LEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQW

SEQ ID NO: 296 - protein, 226 aa, Sus scrofa
TKLVWIETPTNPILKMIDIEACAQIVHKHGDIILVVDNTFMSAYFQRPLALGADICMYSATKYMNGHSDVVMGLVSLNSETLHSRLRFLQNSLGAVPSPIDCYLCNRGLKTLQVRMEKHFENGMAVAQFLESHPLVEKVIYPGLPSHPQHELAKRQCTGCPGMISFYIKGSLHHAETFLKSLKLFTLAESLGGYESLAELPAIMTHSSVPKSDREVLGIRDTLIRL

SEQ ID NO: 297 - protein, 176 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTLDRHTILKTTLVELGRTLAL

SEQ ID NO: 298 - protein, 276 aa, Sus scrofa
LIIFEIVHRTLAAMLGSLAALAALAVIGDRPTLTQVVEWIDFETLALLFGMMILVAIFSETGFFDYCAVKAYQLSRGRVWAMIIMLCLIAAVLSAFLDNVTTALLFTPVTIRLCEVLNLDPRQVLIAEVIFTNIGGAATAIGDPPNVIIVSNQELRKMGLDFAGFTAHMFAGICFVLLFSFPLLRLLYWNRKLYNKEPSEIVELKHEIHVWRLTAQRISPASREETAVRGLLLEKVLSLERLLARRLHSFHRQISQEDKNWETNIQELQKKHRISD

SEQ ID NO: 299 - protein, 101 aa, Sus scrofa
YLNEDSRENSMPKRPMLVHLHQTAHFDEFDCPPELQHKQELFPKWHLPIKIAAIVSSLTFLYTLLREVIHPFVTSHQQYFYKIPILVINKVLPMVSITLLA

SEQ ID NO: 300 - protein, 201 aa, Sus scrofa
LLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDAS

SEQ ID NO: 301 - protein, 101 aa, Sus scrofa
HGVLGGDLHLSVSEVLSFRHFCNKIWNALRFILNALGEKFIPQPLEELCPTSPMDAWILSCLARTAQECERGFLTRELALVTHALHHFWLHNLCDVYLEAV

SEQ ID NO: 302 - protein, 151 aa, Sus scrofa
MEATAPRRRHLLPLLLLLLLLCGECPPVSGCNEKRMLAMLPRCGKTFAEMMKKVEVWKWCNLSEFIVYYESFTNCTEVETNVVGCYWPNPLAQSFITGVHRRHFHNCSVDRQQWQDPPDEILIPLIVVPILLTLAMTGLVVWRSKRAAQVV

SEQ ID NO: 303 - protein, 176 aa, Solanum tuberosum
LGFSSSEMHELLMRLYVTIHSDHEGGNVSAHTGHLVASALSDPYLSFAAALNGLAGPLHGLANQEVLLWIKSVVEECGENISKEQLKDYVWKTLNSGKVVPGFGHGVLRKTVPRYTCQREFAMKHLPEDPLFQLVSKLYEVFLLFLQNLAKLKPWPNVDAHSGVLLNYYGLTEARY

SEQ ID NO: 304 - protein, 76 aa, Sus scrofa
VVLARSDPKNSVVYRLLIPWIGCGLLLLNGQTWFQRRRMLTPAFHYDILKPYVGLMAKSVQVMLDKWEQLVAQDPR

SEQ ID NO: 305 - protein, 76 aa, Sus scrofa
VVPILVITVCYGLMLLRLRSVRLLSGSKEKDRSLRRITRMVLVVVGAFVVCWAPIHIFVIVWTLVDIDRRDPLVVA

SEQ ID NO: 306 - protein, 126 aa, Malus domestica
DIPKLFTKFAQTQALATRNSGGSGLGLAICKRFVNLMEGHIWIESEGLGKGCTATFIVKLGFPERSNESKLPFAPKLQANHVQTNFPGLKVLVMDDNGVSRSVTKGLLAHLGCDVTAVSLIDELLH

SEQ ID NO: 307 - protein, 201 aa, Sus scrofa
LKHLDLSFNEIITMKSNFMGLEQLEYLDFQHSSLKQANDFSIFLSLRNLHYLDISYTNIHVVFRGIFAGLVSLQTLKMAGNSFQNNLLPDVFTDLTNLILLDLSKCQLEQVSQRAFHSLPRLQVLNMSHNRLLFLDTLPYKPLHSLRILDCSYNLIVASKEQELQHLPRSLAFLNLTKNDFSCACEHQTFLQWVKDQKQLL

SEQ ID NO: 308 - protein, 101 aa, Capra hircus
MLLRLLLLLAPCGAGFATEVVSISLRGNWKIHNGNGSLQLPAAVPGCVHSALFNKRIIKDPYYRFNNLDYRWIALDNWTYIKKFKLHSDMSEWNKVNLVFE

SEQ ID NO: 309 - protein, 101 aa, Solanum tuberosum
PSESHLDSLVGQALFGDGAAAIIMGSDPIIGVERPLFELVSAAQTLVPDSEGAIDGHLREVGLTFHLLKDVPGLISKNIEKSLLEAFQPLGISDWNSLFWI

SEQ ID NO: 310 - protein, 101 aa, Solanum tuberosum; identical to SEQ ID NO: 309

SEQ ID NO: 311 - protein, 151 aa, Sus scrofa
ISENPQKAITELPLLRAALKETLRLYPVGIFLDRCVTSDLVLQNYHIPAGTLVKVLLYSLGRNPAVFARPERYHPQRWLDNQGSGTRFPHLAFGFGMRQCLGRRLAQVEMLLLLHHVLKNFLVETLVQEDIKMIYRFIMTPSTLPLLTFRA

SEQ ID NO: 312 - protein, 201 aa, Salmo salar
GGGWCGPRITMPPEQVLFLLQGAEPPALCSRQKVARPYTEVTMMTLLTSMADKELVHMIAWAKKVPGFQELSLHDQVQLLESSWLEVLMIGLIWRSIHCPGKLIFAQDLILDRSEGDCVEGMAEIFDMLLATVSRFRMLKLKPEEFVCLKAIILLNSGAFSFCSNSVESLHNSSAVESMLDNITDALIHHISHSGASVQQQ

SEQ ID NO: 313 - protein, 126 aa, Sus scrofa
ARLRRVKTAVAVSSVVWATELGANSVPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAVY

SEQ ID NO: 314 - protein, 176 aa, Solanum tuberosum
EYIYALAQDHGLNRNRSILLENSGYNNKLSFLIVKRLITRMYQQNHFIISTNDSNKNPFLGCNKSLYSQMISEGFACIVEIPFSIRLISSLSSFEGKKIFKSHNLRSIHSTFPFLEDNFAHLNYVLDILIPYPVHLEILVQTLRYWVKDASSLHLLRFFLHEYCNLNSLITSKKPG

SEQ ID NO: 315 - protein, 76 aa, Sus scrofa
IMRILRILKLARHSTGLQSLGFTLRRSYNELGLLILFLAMGIMIFSSLVFFAEKDEDDTKFKSIPASFWWATITMT

SEQ ID NO: 316 - protein, 76 aa, Sus scrofa
MGILSVDLLITLQILPVFFSNCLFLALYDSVILLKHVVLLLSRSKSTRGEWRRMLTSEGMRCIWKSFLLDAYKQVK

SEQ ID NO: 317 - protein, 126 aa, Sus scrofa
PPELFALPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINLAVLHSYQLAKVTIVDHHAAT

SEQ ID NO: 318 - protein, 76 aa, Salmo salar
MADLGVKAGDKVLLVWSQPSSPTTLKKLAESLGAMVGTDGRVSLENMERLIMSSHAASSYDWVLSSLLSDSFSVHT

SEQ ID NO: 319 - protein, 76 aa, Solanum tuberosum
HPWNLMTTSADEGQFLNMLLKLINAKNTMEIGVFTGYSLLATAMALPDDGKILAMDINRENYEIGLPVIEKAGLAH

SEQ ID NO: 320 - protein, 76 aa, Sus scrofa
VVLARSEPKAPVLYRLLIPWIGCGLLLLNGQTWFQRRRMLTPAFHYDILKPYVGLMAKSVQVMLDKWEQLVAQDPR

SEQ ID NO: 321 - protein, 76 aa, Sus scrofa
SDLFNCLANASVISLLSLNLHGLEALPNDFRWQHLEVVNCKLQQFPALKFNSLKKFVFKDNKHMHTFTEINLPNLQ

SEQ ID NO: 322 - protein, 76 aa, Solanum tuberosum
MEVLMAERANLVFHNKAIDGTAMKRLISRLIEHFGMAYTSHILDQVKTLGFQQATATSISLGIDDLLTIPSKGWLV

SEQ ID NO: 323 - protein, 76 aa, Sus scrofa
VVLARSEPKAPVLYRLLIPWIGCGLLLLNGQMWFQRRRMLTPAFHYDILKPYVGLMAKSVQVMLDKWEQLVAQDPR

SEQ ID NO: 324 - protein, 251 aa, Sus scrofa
LNYLSTLILTGNPIQSLALGAFSGLPSLQKLVAVETNLASLEDFPIGHLKTLNELNVAHNHIHSFKLPEYFSNLPNLEHLDLSKNKIENIYHEHLQVLHQVPLHNLSLDLSLNPLNFIEPGAFNKIRLNGLTLRSNFNSSDVMKTCIQGLAGSKVNQLVLGEFKNERNLESFDKSVLEELCNLTLEQFRIAHFGEFPDDVSDLFNCLANASVISLLSLNLHGLEALPNDFRWQHLEVVNCKLQQFPALKFN

SEQ ID NO: 325 - protein, 176 aa, Sus scrofa
AAEFRHLQLKEQKNAGARTNEGPLIVTEELHSLSFETQLCQPGLVIDLETTSLPVVVISNVSQLPSGWASILWYNMLVAEPRNLSFFLNPPCARWSQLSEVLSWQFSSVTKRGLNVDQLNMLGEKLLGPTAGPDGLIPWTRFCKENINDKNFPFWLWIESILELIKKHLLSLWNDG

SEQ ID NO: 326 - protein, 76 aa, Sus scrofa
WAIGLSVADLIESMLKNLSRIHPVSTMVQGMYGIENEVFLSLPCVLNARGLTSVINQKLKDDEVAQLKNSADTLWG

SEQ ID NO: 327 - protein, 76 aa, Sus scrofa
MELGAAARAWSLLWLLLPLLGLVGASGPRTLVLLDNLNLRETHSLFFRSLKDRGFVLTFKTADDPSLSLIKYGEFL

SEQ ID NO: 328 - protein, 101 aa, Sus scrofa
MANYTSAPEDDYDVFIEDDLSNDERELCSPYDPQALLAQLVPYLFITVFLVGLLDNILVVLIMVKYKGLKQVENIYLLNLAVCNLCFLCTLPFWVHMAWHE

SEQ ID NO: 329 - protein, 101 aa, Sus scrofa
MKYLMASSVFVLFILAPSLALMNPGDGHPQEGSVGSQSIRVNALGSMISIRDNNVLSEWDGILDYENGLLAAKLFSKMACVLTKMDKAVFPTLDDISKALD

SEQ ID NO: 330 - protein, 251 aa, Prunus persica
RSIHSIFPFLEDKFPHLNYVSDVLIPYPIHLEILVQTLRYWVKDASSLHLLRLFLHEYYNWNSLITSNNFFFSKSNPRLFLLLYNSHVCEYEFILLFLRNQSSHLQLTSSGIFFERIHFYEKIKYPVEKVFANDFPASILWFFKDPFMHYVRYQGKSILASKDTPLLMNKWKYYLVNLWQCHSYVWSQPGRIYINKLSKHSLDFLGYFSSIRPNLSVVRSQMLENSFITDNAMKKLDTLVPIIPLIGSLAK

SEQ ID NO: 331 - protein, 101 aa, Sus scrofa
MINKSFFEIMLVLLASSTGFSRELKLVLSQQRRVNRESLKLLNKLQTSSIQQCLPHRKNFLLPQKSMNPHQYQKQQALAILHEMLQQIFSLFRAVISLDGW

SEQ ID NO: 332 - protein, 151 aa, Sus scrofa
EVKLRIAQGLSSESWSIMKNMATELGIILIGYFTLVPAIQEFCLFAVVGLVSDFFLQMPFFTTVLSIDIRRMELADLNKRLPPEACLPPAKPVGRSARFERQLAVRPATPHTITLQPSSFRNLRLPKRLRVIYFLARTRLAQRLIMAGTVV

SEQ ID NO: 333 - protein, 101 aa, Salmo salar
DHKLQGTQNKCTKFLLCCLKCCFWCLEKFIKFINRNAYIMVAIYGKNFCTSAKDAFFLLMRNMIRVAVLDKVTDFLLFLGKLLIVGLVGIFAFFFFSGRVK

SEQ ID NO: 334 - protein, 76 aa, Capra hircus
SLEKTGELLLTLKNLNNLDISKNNFLSMPETCQWPGKMKQLNLSSTRIHSLTQCLPQTLEILDVSNNNLDSFSLIL

SEQ ID NO: 335 - protein, 126 aa, Sus scrofa
MKAPAVLAPGILVLLFTLVQKSKGECKEALVKSTMNLNMQYQLPNFTAETPIQNVVLHKHHIYLGALNYIYVLNDIDLRKVAEYKTGPVLEHPDCFPCQDCSHKANLSGGIWRDNINMALLVDTYY

SEQ ID NO: 336 - protein, 76 aa, Sus scrofa
MGFWKFPPFLVLSILVLYQAGMFHTAPVRLPLESSFDSATLTEEEVSLLLVAMVKDYVQMKATVLEQESEDFSITA

SEQ ID NO: 337 - protein, 76 aa, Solanum tuberosum
MKNVTDSFVSLGHWPSAGSFGFNTDILATNPINLSVVLGVLIFFGKGVLSDLLDNRKQRILNTIRNSEELRGGAIE

SEQ ID NO: 338 - protein, 126 aa, Salmo salar
MGQVFLLMPVLLVSCFLSQGAAMENQRLFNIAVNRVQHLHLMAQKMFNDFEGTLLPDERRQLNKIFLLDFCNSDSIVSPIDKLETQKSSVLKLLHISFRLIESWEYPSQTLTISNSLMVRNSNQIS

SEQ ID NO: 339 - protein, 176 aa, Sus scrofa
SKMTHIEIRNTRSLTYINPGALKDLPLLKFLGIFNTGLRIFPDLTKVYSTDVFFILEITDNPYMTSIPANAFQGLCNETLTLKLYNNGFTSVQGHAFNGTKLDAVYLNKNKYLTVIDKDAFGGVFSGPTLLDVSYTSVTALPPKGLEHLKELIARNTWTLKKLPLSLSFLHLTRAD

SEQ ID NO: 340 - protein, 176 aa, Sus scrofa
SDLFNCLANASVISLLSLNLHGLEALPNDFRWQHLEVVNCKLQQFPALKFNSLKKFVFKDNKHMHTFTEINLPNLQFLDLSGNHLSFKGCCSHNEFGTTKLKHLDLSFNEIITMKSNFMGLEQLEYLDFQHSSLKQANDFSIFLSLRNLHYLDISYTNIHVVFRGIFAGLVSLQTL

SEQ ID NO: 341 - protein, 101 aa, Sus scrofa
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVD

SEQ ID NO: 342 - protein, 276 aa, Sus scrofa
SDLFNCLANASVISLLSLNLHGLEALPNDFRWQHLEVVNCKLQQFPALKFNSLKKFVFKDNKHMHTFTEINLPNLQFLDLSGNHLSFKGCCSHNEFGTTKLKHLDLSFNEIITMKSNFMGLEQLEYLDFQHSSLKQANDFSIFLSLRNLHYLDISYTNIHVVFRGIFAGLVSLQTLKMAGNSFQNNLLPDVFTDLTNLILLDLSKCQLEQVSQRAFHSLPRLQVLNMSHNRLLFLDTLPYKPLHSLRILDCSYNLIVASKEQELQHLPRSLAFLNL

SEQ ID NO: 343 - protein, 251 aa, Sus scrofa
FSSFVFSTVVIHFLDKELTGLNEALPFFLLLIDLSRASALAKFALSSNSQDEVRENIARGMAILGPTFTLDALVECLVIGVGTMSGVRQLEIMCCFGCMSVLATYFVFMTFFPACVSLVLELSRESREGRPIWQLSHFARVLEGEENKPNPVTQRVKIIMSLGLVLVHAHSRWIADPSPQNSTADNSKVSLGLDENVSKRIEPSVSLWQFYLSKMISMDIEQVITLTLALLLAVKYIFFEQAETESTLSLK

SEQ ID NO: 344 - protein, 176 aa, Sus scrofa
GGGHSPSDIACTDGFMIHMGKMNRVLKVDMEKKQVTVEAGILLADLHPQLDKHGLALSNLGAVSDVTAGGVIGSGTHNTGIKHGILATQVVELTLLTPDGTVLVCSESSNAEVFQAARVHLGCLGVILTVTLQCVPQFHLQETTFPSTLKEVLDNLDSHLKKSEYFRFLWFPHSEN

SEQ ID NO: 345 - protein, 176 aa, Sus scrofa
VAEPDSKNVYRFELDTSERKIEFDSASGTYTLYLIIGDATLKNPIHWNVADVVIRFPEEDAPSTVLSKNLFTAKQEIQHLFRDPEKRPPTVVSNTFTGLILSPLLLLFALWIRIGAKISNFTFGLTIIFHLGHAMLAMYVYWTQLNMFQTLKYLAILGSVTFLAGNRMLAQQAIKR

SEQ ID NO: 346 - protein, 201 aa, Sus scrofa
SLILASQLICVADPVTCNATHVTLAIPEFPGKLKSVNLGSGNIAVSQLHKHGIEMETTNGLRLHFNQTLLKTNVSEKCLPHQLYLSSLKLTFHSQLEAVSMVIYPECLCESTVSLVSEELCTQDGFMDVKVHSHQTKPALNLDTLRVGDSSCQPTFKAPAQGLVQFRIPLNGCGTRHKFKNDKVIYENEIHALWADPPSAV

SEQ ID NO: 347 - protein, 276 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALM

SEQ ID NO: 348 - protein, 101 aa, Sus scrofa
KFLSDSHRLSYTTLLLVLQYFGPLCFIFICYFKIYIRLKRRNNMMDKMRDNKYRSSETKRINVMLLSIVVAFAVCWLPLTIFNTVFDWNHQIIATCNHNLL

SEQ ID NO: 349 - protein, 101 aa, Capra hircus
MRCGPLYRFLWLWPYLSYVEAVPIRKVQDDTKTLIKTIVTRINDISHTQSVSSKQRVTGLDFIPGLHPLLSLSKMDQTLAIYQQILASLPSRNVIQISNDL

SEQ ID NO: 350 - protein, 201 aa, Sus scrofa
MEDNTPRQRDPISLTSVANGLENMGAELLESLEEGRAPGSDSSPAEVGGGWSKAGPEHLGRRSLQPALRVRRFCREHTQLFRWICTGLLCTAFAAFLLIACLLDFQRALALFVLFCVVLFFLAHSLLKRLLGPKLLRCVKPLRHPCLNLWFKRGLALAAFLGLVLWLVLDTAQRPEQLVSFGGICVFILLLFAGSKHHRAV

SEQ ID NO: 351 - protein, 101 aa, Sus scrofa
IPRSNVSVAIFMLDTVTLCGNSDDFVSQQPERPRNLALARTQLAWIKKQLAAAKEDYVLVAGHYPVWSIAEHGPTHCLVKQLLPLLTTHKVTAYLCGHDHN

SEQ ID NO: 352 - protein, 276 aa, Sus scrofa
MSLTPLLQLALLLALPRSLRGKGCPSPPCECHQEDDFRVTCKDIHSIPPLPPNTQTLKFIETHLKTIPSRAFSNLPNISRIYLSIDATLQQLESQSFYNLSKMTHIEIRNTRSLTYINPGALKDLPLLKFLGIFNTGLRIFPDLTKVYSTDVFFILEITDNPYMTSIPANAFQGLCNETLTLKLYNNGFTSVQGHAFNGTKLDAVYLNKNKYLTVIDKDAFGGVFSGPTLLDVSYTSVTALPPKGLEHLKELIARNTWTLKKLPLSLSFLHLTRAD

SEQ ID NO: 353 - protein, 176 aa, Salmo salar
MAHPSQLGFQDAASPVMEELLHFHDHALMIVLLISTLVLYIIVAMVSTKLTNKYILDSQEIEIVWTVLPAVILILIALPSLRILYLMDEINDPHLTIKAMGHQWYWSYEYTDYEDLGFDSYMVPTQDLTPGQFRLLETDHRMVVPVESPIRVLVSAEDVLHSWAVPSLGVKMDASP

SEQ ID NO: 354 - protein, 126 aa, Sus scrofa
RTLTGTALAGFTIIVMPLELEWLDVGHRTVAGVLSSTFWTGGVMLLALVGYLIRDWRWLLLAVTLPCAPGILSLWWVPESARWLLTQGRVEDAHRYLLRCARLNGRPVGEDGLSREALSKVAAAER

SEQ ID NO: 355 - protein, 151 aa, Sus scrofa
RLVLNTPSFPSNYWDKFVKRKVLDKHGDIYGRERIAELLGMDLATLEITAHNERKPEPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTV

SEQ ID NO: 356 - protein, 101 aa, Prunus persica
VRYQGKSILASKDTPLLMNKWKYYLVNLWQCHSYVWSQPGRIYINKLSKHSLDFLGYFSSIRPNLSVVRSQMLENSFITDNAMKKLDTLVPIIPLIGSLAK

SEQ ID NO: 357 - protein, 176 aa, Capra hircus
MAYPMQLGFQDATSPIMEELLHFHDHTLMIVFLISSLVLYIISLMLTTKLTHTSTMDAQEVETVWTILPAIILIMIALPSLRILYMMDEINNPSLTVKTMGHQWYWSYEYTDYEDLSFDSYMIPTSELKPGELRLLEVDNRVVLPMEMTIRMLISSEDVLHSWAVPSLGLKTDAIP

SEQ ID NO: 358 - protein, 176 aa, Sus scrofa
MAYPFQLGFQDATSPIMEELLHFHDHTLMIVFLISSLVLYIISLMLTTKLTHTSTMDAQEVETIWTILPAIILILIALPSLRILYMMDEINNPALTVKTMGHQWYWSYEYTDYEDLTFDSYMIPTSDLKPGEMRLLEVDNRVVLPMEMTIRMLVSSEDVLHSWAVPSLGLKTDAIP

SEQ ID NO: 359 - protein, 76 aa, Sus scrofa
MTYERILYISLEMLVCAIHPIPGEYKFFWTARLAFSYTPSRAEADVDIILSIPMFLRLYLIARVMLLHSKLFTDAS

SEQ ID NO: 360 - protein, 76 aa, Sus scrofa
KEPCFREENAHFNRIFLPTVYSIIFLTGIVGNGLVILVMGYQKKLRSMTDKYRLHLSVADLLFVLTLPFWAVDAVA

SEQ ID NO: 361 - protein, 176 aa, Sus scrofa
LSTIALSLNTLPELQSLDEFGQTTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFFAEKDEDDTKFKSIPASFWWATITMT

SEQ ID NO: 362 - protein, 226 aa, Malus domestica
MLACNCIEPQWPADELLMKYQYISDFFIALAYFSIPLELIYFVKKSAVFPYRWVLVQFGAFIVLCGATHLINLWTFSIHSRTVAMVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKI

SEQ ID NO: 363 - protein, 76 aa, Capra hircus
GFFFSHVGWLLVRKHPAVREKGATLDLSDLRAEKLVMFQRRYYKPGVLLLCFILPTLVPWYLWGETFQNSLFFATL

SEQ ID NO: 364 - protein, 126 aa, Sus scrofa
ASLIRYEVNISTENAAGGVQRVEILDGRTECVLSNLRGGTRYTFMVRARMAEPSFGGFWSAWSEPASLLTASDLDPLILTLSLILVLILLLLAVLALLSHRRTLKQKIWPGIPSPEGEFEGLFTTH

SEQ ID NO: 365 - protein, 101 aa, Sus scrofa
ATVKVPMMFQSRAMKYLNDSLLPCQLVQLEYTGNETAFFILPVKGEMDTVIAGLSRDTIQRWSKSLIPSQVDLYVPKVSISGAYDLGSILGDMGIVDLLSH

SEQ ID NO: 366 - protein, 76 aa, Sus scrofa
MKLAAPSLALLLSTATLVSGAWNRRSRSCGGVLRDPPGKIFNSDGPQKDCVWTIKVKPHFHVVLAIPPLNLSCGKE

SEQ ID NO: 367 - protein, 76 aa, Sus scrofa
VHADNIAGKAFVSAVNSLVFQQTGANWNIQCWMKEDLKLFICYMESLFKNPFKNYDLKVHLLYVLLEVLEGSPLLP

SEQ ID NO: 368 - protein, 101 aa, Sus scrofa
ICDGTASIQARQTCATCFGVCCFIATDDITELYSTLQCLENIFTKSYLKEKDSNVICSTPNTALHISSLLAWTLLLTICPLSEVKKKLEMHVHKLPSLLSS

SEQ ID NO: 369 - protein, 76 aa, Sus scrofa
RSLEAAGHTLIPFLPANIPHALEALSTGGLFSDGGKRLLQNFEGDYVDSCLGDLISILRLPKWLKGLLAFMLRPLL

SEQ ID NO: 370 - protein, 176 aa, Sus scrofa
MVLVWLLLLLTLLAGARLLWGQWKLRNLHLPPLVPGFLHLLQPNLPIYLLGLTQRLGPIYRLRLGLQDVVVLNSKRTIEEALVRKWVDFAGRPQIPSYKLASQHCPDISLGDYSLFWKAHKKLTRSALLLGVRSSMEPRVEQLTQEFCERMRAQAGTPVTIQKEFSVLTCSIICCL

SEQ ID NO: 371 - protein, 201 aa, Sus scrofa
KSRDRDRHREITNKSKESTWALIHSVSDAFSGWLLMLLIGLLSGSLAGLIDISAHWMTDLKEGICTEGLWFNHEHCCWNSKHVTFKDRDKCPEWNSWSQLIISADEGAFAYIVNYFMYVLWALLFAFLAVSLVKVFAPYACGSGIPEIKTILSGFIIRGYLGKWTLIIKTITLVLAVSSGLSLGKEGPLVHVACCCGNILC

SEQ ID NO: 372 - protein, 76 aa, Sus scrofa
VLLAHSPHRDLGIFWLNAAETWVDISSNTAGKTLFGKMLDYLQGSGETPQTDVRWMSESGIIDVFLLLGPSVFDVF

SEQ ID NO: 373 - protein, 76 aa, Sus scrofa
NITLESSILLQIKHIIRSCLLSVEPAISTRHLPYQSFQLFGFDFMVDEDLKVWLIEVNGAPACAQKLYAELCQGIV

SEQ ID NO: 374 - protein, 76 aa, Meleagris gallopavo
NYIEIPNDFRVKDMIVWIVLGVLSSLICLIMSWTMVLKGYRMITFILPPVPGPKIKGIDTHLLETGKSEELLSALG

SEQ ID NO: 375 - protein, 101 aa, Sus scrofa
VMLHRRLWNKLEWTLQYNLTHDVTSVVRPVLWLLLGPRTLTTGLRQRSGLELQHRPVVLFRELGGTVQNGPGPRKQEPVTLPPSLHLQILSIPGWKYSSNH

SEQ ID NO: 376 - protein, 201 aa, Sus scrofa
MTVPALASASGLLQVASLLGLLLLLLKAAQLYLRRQWLLKALQQFPSPPSHWLYGHSREFQEESELQPLLKRVEKYPSACARWLWGTRAMVLVYDPDYMKVVLARSEPKAPVLYRLLIPWIGCGLLLLNGQTWFQRRRMLTPAFHYDILKPYVGLMAKSVQVMLDKWEQLVAQDPRLEIVGPVSLMTLDTIMKCAFSHQGS

SEQ ID NO: 377 - protein, 151 aa, Sus scrofa
FSSFVFSTVVIHFLDKELTGLNEALPFFLLLIDLSRASALAKFALSSNSQDEVRENIARGMAILGPTFTLDALVECLVIGVGTMSGVRQLEIMCCFGCMSVLATYFVFMTFFPACVSLVLELSRESREGRPIWQLSHFARVLEGEENKPNP

SEQ ID NO: 378 - protein, 101 aa, Sus scrofa
MPLLWLRGFLLASCWIIVRSSPTPGSGGHSAAPDCPSCALATLPKDVPNSQPEMVEAVKKHILNMLHLKKRPDVTQPVPKAALLNAIRKLHVGKVGENGYV

SEQ ID NO: 379 - protein, 101 aa, Sus scrofa
FGALILTLVQIARAILEYIDHKLRGAQNPVARCIMCCFKCCLWCLEKFIKFLNRNAYIMIAIYGKNFCVSAKNAFMLLMRNIVRVVVLDKVTDLLLFFGKL

SEQ ID NO: 380 - protein, 201 aa, Sus scrofa
MTVPALASVSGLLQVASLLGLLLLLLKAAQLYLRRQWLLKALQQFPSPPSHWLYGHSREFQEESELQPLLKRVEKYPSACARWLWGTRAMVLVYDPDYMKVVLARSEPKAPVLYRLLIPWIGCGLLLLNGQMWFQRRRMLTPAFHYDILKPYVGLMAKSVQVMLDKWEQLVAQDPRLEIVGPVSLMTLDTIMKCAFSHQGS

SEQ ID NO: 381 - protein, 76 aa, Sus scrofa
SLYKYIFPAHLQKPTLAVIGLIKPLGSLLPTGDTQARWAVRVLKGVNKLPPSSVMIQEVNTRKENKPSGFGLCYCK

SEQ ID NO: 382 - protein, 126 aa, Sus scrofa
MGPIGAEADENQTVEEMKMEPSGPGHTTPRGELAPDSEPELKDSTKLIEVQIILILAYCSIILLGVVGNSLVIHVVIKFKSMRTVTNFFIANLAVADLLVNTLCLPFTLTYTLMGEWKMGPVLCHL

SEQ ID NO: 383 - protein, 76 aa, Sus scrofa
MGKLLLWVGLVLVLKHHNGAAHKLVCYFANWAFSRPGPASILPRDLDPFLCTHLVFAFASMNDSQIVAKDARDESI

SEQ ID NO: 384 - protein, 101 aa, Solanum tuberosum
IKRWYNNLKYFLLDNWRRVWVLLLWIGVMAGLFAYKYVQYKNKAAFNVMGHCVCVAKGAAEVLKLNMALILLPVCRNTITWLRNKTKLGGAVPFDDNINFH

SEQ ID NO: 385 - protein, 76 aa, Salmo salar
KKMSLHSHAHALELPAGAAHQVELFLGSDTVQEENIKVNIWMGSVAETKGQYSVLTTVGECLPLSTFYSTDSITLL

SEQ ID NO: 386 - protein, 101 aa, Sus scrofa
MKLGSAIPWALLFSTATLISTGWGLDYHACGGRLTDDYGTIFTYKGPKTECVWTLQVDPKYKLLVSIPTLNLTCGKEYVEILEGAPGSKSLGKFCEGLSIL

SEQ ID NO: 387 - protein, 151 aa, Sus scrofa
DALFGYQFLNGTNPMLLRHSVELPARLKFPPGMEELQAQLEKELQGGTLFEADFSLLDGIKANVILCSQQYLAVPLVMLKLQPDGKLLPMVIQLQLPREGSPLPPLFLPTDPPMVWLLAKCWVRSSDFQLHELHSHLLRGHLMAEVIAVAT

SEQ ID NO: 388 - protein, 76 aa, Salmo salar
WKERKTCAAQLLSYPGKNKIPLNYHIVEVIFGELFQLPCPPHIDVMYTTLLIELCKLQPGSLPQVLAQATEMMYVR

SEQ ID NO: 389 - protein, 176 aa, Sus scrofa
KEPCFREENAHFNRIFLPTVYSIIFLTGIVGNGLVILVMGYQKKLRSMTDKYRLHLSVADLLFVLTLPFWAVDAVANWYFGKFLCKAVHVIYTVNLYSSVLILAFISLDRYLAIVHATNSQRPRKLLAEKVVYVGVWIPALLLTIPDFIFANVREGDGRYICDRFYPNDLWLVVFQ

SEQ ID NO: 390 - protein, 201 aa, Sus scrofa
MTVPALASASGLLQVASLLGLLLLLLKAAQLYLHRQWLLKALQQFPSPPSHWLYGHSREFQEESELPPLLKRVEKYPSACALWRWGTRAMVLVYDPDYMKVVLARSDPKNSVVYRLLIPWIGCGLLLLNGQTWFQRRRMLTPAFHYDILKPYVGLMAKSVQVMLDKWEQLVAQDPRLEIVGPVSLMTLDTIMKCAFSHQGS

SEQ ID NO: 391 - protein, 151 aa, Solanum tuberosum
SLCLKKCVEKGQMYRTFQRDSAFSTLSKWNLFQTYMPWFLTSTGYKYLNLIFLDTFSDLLPILSSSQKFVSIFPDIMHGSGISWRILQKKLCLPQWNLISEISSKCLHNLLLSEEMIHRNNESPLISTHLRSPNAREFLYSILFLLLVAGY

SEQ ID NO: 392 - protein, 201 aa, Solanum tuberosum
LSASANRLSTIQKQSDEYAAMIMEELDPNNLGYIMIENLEMLLLQAPNQSVQRGGESRNLSQMLSQKLKHTQEPNPLVRWYKSFMYFLLDNWQRVWVLLLWIGIMAVLFTWKYIQYKQKAAYDVMGPCVCLAKGAAETIKLNMAIILLPVCRNTITWLRNKTRLGSAVPFDDNLNFHKVIAVAIALGVAIHGLAHLTCDFP

SEQ ID NO: 393 - protein, 101 aa, Malus domestica
VRYQGKSILSSKDTPLLMNKWKYYLVNLWQCHSYVWSQPGRIYINQLSKHSLDFLGYFSSMRPNLSVVRGQMLENSFIMDNAMKKLDTLVPIIPLIGSLAK

SEQ ID NO: 394 - protein, 101 aa, Sus scrofa
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVD

SEQ ID NO: 395 - protein, 101 aa, Sus scrofa
LELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFT

SEQ ID NO: 396 - protein, 101 aa, Sus scrofa
MEVLGFLSPELNGPMVTMALAVVLLALLKWYSTSAFSRLEKLGIRHPKPSPFIGNLTFFRQGFWESHMELRKQYGPLSGYYLGRRMIVVISDPDMIKQVLA

SEQ ID NO: 397 - protein, 101 aa, Sus scrofa
RRRPYILALGVMMLLGMALYLNGDTIISALIADPRRKPIWAISITMTGVVLFDFAADFIDGPIKAYLFDVCTHQDKERGLHYHALFTGLGGALGYLLGAID

SEQ ID NO: 398 - protein, 76 aa, Sus scrofa
ISRNITSIHIENWRGLHTLNAVDMELYTGLQKLTIKNSGLRSIQPRAFAKNPHLRYINLSSNRLTTLSWQLFQTLS

SEQ ID NO: 399 - protein, 226 aa, Sus scrofa
MGPIGAEADENQTVEEMKMEPSGPGHTTPRGELAPDSEPELKDSTKLIEVQIILILAYCSIILLGVVGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLL

SEQ ID NO: 400 - protein, 226 aa, Sus scrofa
LLGRIIASYDPDNKAERSIAIYLGVGLCLLFIVRTLLLHPAIFGPHHIGMQMRIAMFSLIYKKTLKLSSRVLDKISIGQLVSLLSNNLNKFDEGLALAHFVWIAPLQVTLLMGLLWELLQASAFCGLAFLVVLALFQAGLGKMMMKYRDQRAGKINERLVITSEMIENIQSVKAYCWEEAMEKMIENLRQTELKLTRKAAYVRYFNSSAFFFSGLFVVFLSVLPYA

SEQ ID NO: 401 - protein, 76 aa, Solanum tuberosum
WYSHHLFIIVYTLLIVHGEKLYITKDWYKRSTWMYLTVPLVLYAGERLLRAFRSSIKAVKILKVAVYPGNVLALHM

SEQ ID NO: 402 - protein, 176 aa, Sus scrofa
ELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPLPPVAATSYVGCRVAVTFFLYFLATNYYWILVEGLYLHSLIFMAFFSEKKYLWGFTVFGWGL

SEQ ID NO: 403 - protein, 226 aa, Sus scrofa
NFWQNDRERFHADPDIIGTIHQHEPKTLQTSATLKDLLFGVPGKHSGVSLYTRKRLVSYTITLVFQHYHAKFLGSLRARLMLLHPSPNCSLRAESLVHVHFKEEIGIAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELG

SEQ ID NO: 404 - protein, 76 aa, Sus scrofa
DNTMFLLYTSVDTSKYKVLLTYDTRKNYTNPVDKSPTFIWKNHKLPNDIPGRGPQILMIAVFTLTGTIVLLLLIAL

SEQ ID NO: 405 - protein, 126 aa, Meleagris gallopavo
ILVSILVNFILFICIIRILVQKLHSPDVGHNETSQYSRLAKSTLLLIPLFGIHYIMFAFFPDNFKAQVKLVFELVVGSFQGFVVAVLYCFLNGEVQAELKRKWRRWHLERFLGSDMKYHHPSLGSN

SEQ ID NO: 406 - protein, 176 aa, Sus scrofa
PSPKGGTRAQLVCKLFNLYQGTLEIIHKLLSDTCPRFVLGLLDAGKADLQRQVRPEAWLSSGPNPSPGHLMLVCHVSGFYPKPIWVMWMRDEQEQPGTQQGDILPNADGTWYLRVTLDVAAGEASGLSCRVKHSSLGGQDIILYWEQHSSVGWILLAVIVPLVLLTGLAFWHRKHW

SEQ ID NO: 407 - protein, 101 aa, Sus scrofa
MYVGEVSPTALRGALGTLHQLGIVVGILIAQVFGLDSIMGNEELWPLLLSVIFIPALLQCVLLPFCPESPRFLLINRNEENRAKSVLKKLRGTADVTRDLQ

SEQ ID NO: 408 - protein, 101 aa, Salmo salar
TLVISENSLIVNPSLTIANLEALLLRRTVTVVDVCHSLEQPAITELQWGAIRDMIQALLAHIRQFGQHSAMRNVPHRIEKRHCETWNLCTLFGILLGYPST

SEQ ID NO: 409 - protein, 251 aa, Sus scrofa
YLNEDSRENSMPKRPMLVHLHQTAHFDEFDCPPELQHKQELFPKWHLPIKIAAIVSSLTFLYTLLREVIHPFVTSHQQYFYKIPILVINKVLPMVSITLLALVYLPGVIAAIVQLHNGTKYKKFPHWLDRWMVTRKQFGLLSFFFAVLHAVYSLSYPMRRSYRYKLLNWAYQQVQQNKEDAWIEHDVWRMEIYVSLGIVTLAILALLAVTSIPSVSDSLTWREFHYIQSTLGIVSLLLGTIHALIFAWNKW

SEQ ID NO: 410 - protein, 101 aa, Salmo salar
GGGWCGPRITMPPEQVLFLLQGAEPPALCSRQKVARPYTEVTMMTLLTSMADKELVHMIAWAKKVPGFQELSLHDQVQLLESSWLEVLMIGLIWRSIHCPG

SEQ ID NO: 411 - protein, 76 aa, Sus scrofa
DASNIMRVISIKNYHPKIRIITQMLQYHNKAHLLNIPSWNWKEGDDAICLAELKLGFIAQSCLAQGLSTMLANLFS

SEQ ID NO: 412 - protein, 201 aa, Sus scrofa
FGALILTLVQIARAILEYIDHKLRGAQNPVARCIMCCFKCCLWCLEKFIKFLNRNAYIMIAIYGKNFCVSAKNAFMLLMRNIVRVVVLDKVTDLLLFFGKLLVVGGVGVLSFFFFTGRIQGLGKDFESPQLNYYWLPIMTSIMGAYVIASGFFSVFGMCVDTLFLCFLEDLERNDGSLDRPYYMSKALLKILGKKNEVPSG

SEQ ID NO: 413 - protein, 101 aa, Sus scrofa
MERKLMSLLPSISLSEMEPNSTLGNHNSNRSCTTENFKREFYPIVYLVIFIWGALGNGFSIYVFLKPYKKSTSVNVFMLNLAISDLLFTITLPFRVDYYLR

SEQ ID NO: 414 - protein, 101 aa, Solanum tuberosum
MDVRRRPVKPLYPSEHISSGEPLKPHNQDSSVKASDALPLPLYLTNGLFFTMFFSVMYFLLHRWREKIRNGIPLHVLNFSELVAMVSLIASVIYLLGFFGI

SEQ ID NO: 415 - protein, 101 aa, Solanum tuberosum
MDVRRRPVKPLYTSKDASAGEPLKQQEVSSPKASDALPLPLYLTNGLFFTMFFSVMYFLLVRWREKIRNSIPLHVVTLSELLAMVSLIASVIYLLGFFGIG

SEQ ID NO: 416 - protein, 76 aa, Sus scrofa
MVLWGPVLGVLLVAIVGYLCLQGLLRQRRPEEPPLDKGSVPWLGHAMTFRKNMLEFLKHMWARHGDIFTVQLGGQY

SEQ ID NO: 417 - protein, 76 aa, Sus scrofa
AALLVNLFFLLNIVRVLITKLKVTHQAESNLYMKAVRATLILVPLLGIEFVLIPWRPEGKIAEEVYDYIMHILVHY

SEQ ID NO: 418 - protein, 201 aa, Sus scrofa
MANYTSAPEDDYDVFIEDDLSNDERELCSPYDPQALLAQLVPYLFITVFLVGLLDNILVVLIMVKYKGLKQVENIYLLNLAVCNLCFLCTLPFWVHMAWHEGDPGEPLCKILLVLYSVGLFSEAFFNVLLTVQRYQKFFQMRGFFSATRMVAGSIFPSALVWVIAVLVMLPELAFYKPQMENQKYKCFFGRPLFLPADETF

SEQ ID NO: 419 - protein, 176 aa, Sus scrofa
KLVPFIQKASVGITVLSLCALSIDRYRAVASWSRIKGIGVPKWTAVEIVLIWVVSVVLAVPEALGFDMITTDYKGNRLRICLLHPTQKTAFMQFYKTAKDWWLFSFYFCLPLAITAFFYTLMTCEMLRKKSGMQIALNDHLKQRREVAKTVFCLVLVFALCWLPLHLSRILKLTLY

SEQ ID NO: 420 - protein, 76 aa, Capra hircus
MRGARGAWDFLFVLLLLLLVQTGSSQPSVSPGELSLPSIHPAKSELIVSVGDEIRLLCTDPGFVKWTFEILGQLSE

SEQ ID NO: 421 - protein, 226 aa, Sus scrofa
MVLEMLNPMNISSMVSEAVLFGSIAILLLIGLLLWVWNYEDTSSIPGPGYFLGIGPLISHFRFLWMGIGSACNYYNKMYGEFMRVWIGGEETLIISKSSSIFHIMKHNHYTCRFGSKLGLECIGMHEKGIMFNNNPALWKAVRPFFTKALSGPGLVRMVTVCADSITKHLDKLEEVRNDLGYVDVLTLMRRIMLDTSNNLFLGIPLDESALVHKVQGYFDAWQALL

SEQ ID NO: 422 - protein, 101 aa, Sus scrofa
LSGEEIFRKKAVELGVKLLPAFYTPSGIPWALLNIKSGIGRNWPWASGGSSILAEFGTLHLEFIHLSYLSGNPFFAEKVMNIRKVLNNLEKPQGLYPNYLN

SEQ ID NO: 423 - protein, 201 aa, Sus scrofa
LFIILLWRTLKYLWTVCCHCGGKTKEAQKINNGASQADGTLKPVDEKEEVVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVN

SEQ ID NO: 424 - protein, 226 aa, Sus scrofa
LNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTL

SEQ ID NO: 425 - protein, 276 aa, Sus scrofa
GRMAGPPARTLTPPPCEGPIEIKDTFKYINTVVSCLVFVLGIIGNSTLLRIIYKNKCMRNGPNILIASLALGDLLHIIIDIPINVYKLLAEDWPFGVEMCKLVPFIQKASVGITVLSLCALSIDRYRAVASWSRIKGIGVPKWTAVEIVLIWVVSVVLAVPEALGFDMITTDYKGNRLRICLLHPTQKTAFMQFYKTAKDWWLFSFYFCLPLAITAFFYTLMTCEMLRKKSGMQIALNDHLKQRREVAKTVFCLVLVFALCWLPLHLSRILKLTLY

SEQ ID NO: 426 - protein, 76 aa, Sus scrofa
PGVHLDLGWIAILGAIWLLILADIHDFEIILHRVEWATLLFFAALFILMEALAHLHLIEYVGEQTALLIKMVPEDQ

SEQ ID NO: 427 - protein, 76 aa, Sus scrofa
MTVLSGHVVVCIFGDVSSALIGLRNLVMPLRASNFHYHELKHIVFVGSIEYLKREWETLHNFPKVSILPGTPLSRA

SEQ ID NO: 428 - protein, 101 aa, Solanum tuberosum
HFVKGVEGVSGIIMVVLMSIAFTLASQRFRRNKIRLPRPLNKLTGFNAFWYSHHLFVIVYSLLIVHGIELYLTKEWYKKTTWMYLAIPIILYSGERLLRAF

SEQ ID NO: 429 - protein, 101 aa, Sus scrofa
GLSVTASSLFTSGRFAIDPELRGAEFERIIQNLDVHFWKAFWNITEIEVLSSLANMASATVRVSRLLSLPPKAFEMPLTADPKLTVTISPPLAHTGPGPVL

SEQ ID NO: 430 - protein, 176 aa, Sus scrofa
CHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLC

SEQ ID NO: 431 - protein, 76 aa, Capsicum annuum
PHKQQQEEDNTLLIDASDALPLPLYFTNGLFFTMFFSVMYFLLSRWREKIRNSTPLHVVTLSELGAIVSLIASVIY

SEQ ID NO: 432 - protein, 76 aa, Solanum tuberosum
ENRMDTILHFSTNIIWFGILSGYSILGKEKLVILNSWAQEFLYNLSDTAKALCLLLVTEFFLGYHSPPGWEFAIRS

SEQ ID NO: 433 - protein, 76 aa, Sus scrofa
MKLMALQLLLWHIALWMVPEAAPLSPASSLPQSFLLKCLEQVRKIQADGAELQERLCATHKLCHPQELVLLGHSLG

SEQ ID NO: 434 - protein, 226 aa, Sus scrofa
  MOD_RES (5)..(5): Any amino acid
RGSNXIFGDTPCRIMSYSMYVNMYSSIYFLTVLSVVRFLATVHPFRLLHTTSIKNAWILCGVIWIFIMASSTVLLKNGSEQKDNVTLCLELNSNKVTKLKTMNYVALVVGFVLPFGTLSICYLLIIRALLKVEVPESGLRLSHRKALITVIIALIIFLLCFLPYHVLRTLHLLEWKADKCKDRLHKAVAVTLALAAANSCFNPFLYYFAGENFKDRLKSALRKGRP

SEQ ID NO: 435 - protein, 251 aa, Sus scrofa
MGNGTWEGCHVDSRVDHLFPPSLYIFVIGVGLPTNCLRLWAAYRQVRQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSVPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAVY

SEQ ID NO: 436 - protein, 101 aa, Sus scrofa
PEEETDWIEKHCVKINNDLLISKVFYFFFYSAYGSLYPLLPVYYKQLGMSPSQSGLLVGIRYFIEFCSAPFWGVVADRFKKGKVVLLFSLLCWVLFNLGIG

SEQ ID NO: 437 - protein, 201 aa, Sus scrofa
MVLLGLLQAGGSVLGQAMEQVTGVNLLSSLLLACAFTLILVYLFRQAIGHLAPLPAGAKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFRQHVSIIEKETKEYFQSWGESGERNLFEALSEL

SEQ ID NO: 438 - protein, 101 aa, Salmo salar
ALYVNPTDCYNVHWPISRGQLNVHGGVGGSLTAVLADLEAIWSHVIQKQLEIPLKDLKYYRCILLVPDIYNRHHIKELVNMLLLNMGFSAIVVHQESVCAT

SEQ ID NO: 439 - protein, 126 aa, Sus scrofa
MTTAILQRLSTLSVSGQHLRRLPKILEDGLPKMPGTVPETDVPQLFREPYIRAGYRPIGHEWRYYFFSLFQKHNEVVNVWTHLLAALAVLLRFWAFVETEGLPWTSAHTLPLLLYVLSSITYLTFS

SEQ ID NO: 440 - protein, 176 aa, Sus scrofa
IIKHIAKKNGKSLPASLQSLRPDEEVGEKLKPSFLDLVRTPQIRKHTLILMYNWFTSAVLYQGLVMHMGLAGSNLYLDFFYSALVEFPAALLILLTIDRLGRRHPWAASNVVAGAACLASVFIPEDPHWLRITVLCLGRMGITMAYEMVCLVNAELYPTFIRNLGVLVCSSMCDIG

SEQ ID NO: 441 - protein, 101 aa, Sus scrofa
YEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQS

SEQ ID NO: 442 - protein, 226 aa, Sus scrofa
MDESSGQPDVHTYKSLAEDGPFCSVEPPKRPTGSLVMHSMAMFGREFCYAVEAAYVTPVLLSVGLPKSLYSVVWLLSPVLGFLLQPVVGSASDHCRARWGRRRPYILALGVMMLLGMALYLNGDTIISALIADPRRKPIWAISITMTGVVLFDFAADFIDGPIKAYLFDVCTHQDKERGLHYHALFTGLGGALGYLLGAIDWAHLELGRLLGTEFQVMFFFSSLVL

SEQ ID NO: 443 - protein, 151 aa, Sus scrofa
ITAVIVNRKEHKLKKGAGYHLDLFWVAILMVVCSFMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVH

SEQ ID NO: 444 - protein, 76 aa, Sus scrofa
MEHLERCAWVLRGTLVRAAVRRYLPWALAASMLAGSLLKELSPLPESYLSNKRNVLNVYFVKVAWAWTFCLLLPFI

SEQ ID NO: 445 - protein, 151 aa, Sus scrofa
NIFILVQTYQRDERLQGETLDQQLGRVLGEVAPSMFLSSFSETVAFFLGGLSVVPAVHTFSLFAGMAVLIDFLLQITCFVSLLGLDIKRQEKNRLDVVCCVQGAEDGAGVQASESCLFRFFKNSYAPLLLKDWMRPIVIAVFVGVLSFSIA

SEQ ID NO: 446 - protein, 76 aa, Salmo salar
VIFLDTQPILSPSILDHLINNDRKLPPEYNLPHTYVEMQSLQITAFLFTVCHVVIVIQDWFTDINLYRFLQTAEML

SEQ ID NO: 447 - protein, 201 aa, Salmo salar
ILSSGLCPAMLTPSKPFTRRCFPALDQKKGGEITVGNNSKFDDGEGNIRDAKDLVAGVKNATVVIEARQVVMKIFEDYTQSWYWILIGLVIAMLISLLFIVLLRFLAGIMVWVMIVMVILVIGYGIFHCSMEYVSLKSEAGSNVTLKDLGFQTDFSVYLHIRQTWLAFIIILAIVEVVIILLLIFLRNRILIAIALIKEAS

SEQ ID NO: 448 - protein, 76 aa, Sus scrofa
RVSRSIMRLRKRSRSVFYRLTVLILVFAVSWMPLHLFHVVTDFNDNLISNRHFKLVYCICHLLGMMSCCLNPILYG

SEQ ID NO: 449 - protein, 76 aa, Sus scrofa
GMAHQVNLEYLSRVVFEEKDLLFPDSVVGTDSHITMVNGLGILGWGVGGIETEAVMLGLPVSLTLPEVVGCELTGS

SEQ ID NO: 450 - protein, 226 aa, Sus scrofa
RTLTGTALAGFTIIVMPLELEWLDVGHRTVAGVLSSTFWTGGVMLLALVGYLIRDWRWLLLAVTLPCAPGILSLWWVPESARWLLTQGRVEDAHRYLLRCARLNGRPVGEDGLSREALSKVAAAERVVRRPSYVDLFRTPRLRHISLCCMVVWFGVNFSYYGLSLDVSGLGLNVYQTQLLFGAVELPSKLLVYLSVRHAGRRLTLAGTLLGTSLSLGFRLLVSSEM

SEQ ID NO: 451 - protein, 76 aa, Sus scrofa
LSTIALSLNTLPELQSLDEFGQTTDNPQLAHVEAVCIAWFTMEYLLRFLSSPKKWKFFKGPLNAIDLLAILPYYVT

SEQ ID NO: 452 - protein, 176 aa, Sus scrofa
KGEAPAKSSTHRHDEELGMASAETLTVFLKLLAAGFYGVSSFLIVVVNKSVLTNYRFPSSLCVGLGQMVATVAVLWVGKALRVVKFPDFDRNVPRKTFPLPLLYFGNQITGLFSTKKLNLPMFTVLRRFSILFTMFAEGVLLKKTFSWGIKMTVFAMIIGAFVAASSDLAFDLEGY

SEQ ID NO: 453 - protein, 101 aa, Sus scrofa
MAPALPITLPSKMSLRSLKWSLLLLSLLSFLVMWYLSLPHYNVIERVNWMYFYEYEPIYRQDFHFTLREHSNCSHQNPFLVILVTSHPADVKARQAIRVTW

SEQ ID NO: 454 - protein, 76 aa, Sus scrofa
ALEGVRNEPLSKQQCHGQGGFWHGFDISGHSFLLTFCALMIVEEMAVLHEVKTDRSHCLHVAITALVVALGFLTFI

SEQ ID NO: 455 - protein, 101 aa, Sus scrofa
MANSASPEQNQNHCSAINSSILLTQGNLPTLTLSGKIRVTVTFFLFLLSTAFNASFLLKLQKWTQRKEKGKKLSRMKVLLKHLTLANLLETLIVMPLDGMW

SEQ ID NO: 456 - protein, 76 aa, Sus scrofa
TKSLPSDQVTLVYDQQEVEAIFLVILVVVIIGEFFSASSVTIVDTVTLQYLGKHRDRYGLQRMWGSLGWGLAMLSV

SEQ ID NO: 457 - protein, 101 aa, Sus scrofa
GAMVWTLDLDDVRGTFCGTGPFPLVYMLNDLLLKAEVSSTLSPGFGLSTTVNSSRTCPESLAVTKDLTTDLGILPLGGEAVATETHGRSDNMTVTPGGGLV

SEQ ID NO: 458 - protein, 176 aa, Sus scrofa
MLSALGGLQRCFWAILLLALTVSLLAGFLHKDVRLLMPLLKGQAEGPPITNVMFLKTHKTASSTVLNILFRFAETHNLSVALPAGQRVHLGYPWLFLARYVEGVEEGGPEQRFNIMCNHLRFNLPEVRKVMPNDTFYFSILRNPVFQLESSFIYYKGYVPAFRDVVSLEAFLASPG

SEQ ID NO: 459 - protein, 101 aa, Sus scrofa
DLFTTLVDLKWRFNLLVFTMVYTVTWLFFGFIWWLIAYIRGDLDHVGDQEWIPCVENLSGFVSAFLFSIETETTIGYGFRVITEKCPEGIVLLLVQAILGS

SEQ ID NO: 460 - protein, 226 aa, Sus scrofa
MYVGEVSPTALRGALGTLHQLGIVVGILIAQVFGLDSIMGNEELWPLLLSVIFIPALLQCVLLPFCPESPRFLLINRNEENRAKSVLKKLRGTADVTRDLQEMKEESRQMMREKKVTILELFRSAAYRQPILIAVVLQLSQQLSGINAVFYYSTSIFEKAGVQQPVYATIGSGIVNTAFTVVSLFVVERAGRRTLHLIGLAGMAGCAVLMTIALALLEQLPWMSYL

SEQ ID NO: 461 - protein, 176 aa, Sus scrofa
PRADSFHIFRDPLKGDLPWPGLTFGLSILALWYWCTDQVIVQRCLSAKNMSHVKAGCVMCGYFKLLPMFVIVMPGMISRVLYTEKIACTVPSECEKYCGTKVGCSNIAYPTLVVELMPNGLRGLMLSVILASLMSSLTSIFNSATTLFTMDVYAKIRKRASEKELMIAGRLFILVL

SEQ ID NO: 462 - protein, 126 aa, Sus scrofa
MQLELSTCVFLCLLPLGFSAIRRYYLGAVELSWDYRQSELLRELHVDTRFPATAPGALPLGPSVLYKKTVFVEFTDQLFSVARPRPPWMGLLGPTIQAEVYDTVVVTLKNMASHPVSLHAVGVSFW

SEQ ID NO: 463 - protein, 126 aa, Sus scrofa
GRMAGPPARTLTPPPCEGPIEIKDTFKYINTVVSCLVFVLGIIGNSTLLRIIYKNKCMRNGPNILIASLALGDLLHIIIDIPINVYKLLAEDWPFGVEMCKLVPFIQKASVGITVLSLCALSIDRY

SEQ ID NO: 464 - protein, 76 aa, Solanum tuberosum
QLSNHSRDFMGYLSSVRLNHSMVRSQMLENSFLINNPIKKFETLVPIIPLIGSLAKAHFCTVLGHPISKPVWSDLS

SEQ ID NO: 465 - protein, 76 aa, Sus scrofa
VPATLPQLTPTLVSLLEVIEPEVLYAGYDSSIPDSTWRIMTALNMLGGRQVIAAVKWAKAIPGFRNLHLDDQMTLL

SEQ ID NO: 466 - protein, 126 aa, Sus scrofa
MWAPERSAEEQGNLTRSLGSSEDCGSVSVVFPMTMLITGFVGNALAMLLVSQSYRRRESKRKKSFLLCIGWLALTDMVGQLLTSPVVIVLYLSHQRWEQLDPSGRLCTFFGLTMTAFGLSSLFIAS

SEQ ID NO: 467 - protein, 76 aa, Sus scrofa
LGLGRIGREVATRMQSFGMKTIGYDPIIAPEVSASFGVQQLPLEEIWPLCDFITVHTPLLPSTTGLLNDSTFALCK

SEQ ID NO: 468 - protein, 101 aa, Solanum tuberosum
LIPIRNSLGPLGTCLPIENFYSSYHLITHNQILVTKYLQLDNLKQTFQVIKLKYYLMDENGKIFNPDPCRNIILNPVNLNWSFLHHNYCAETSKIISLGQF

SEQ ID NO: 469 - protein, 251 aa, Sus scrofa
HYYVFFEEQEDEIIGFGQELKNPQEETLQAFDSHYDYTVCGGSEDMVCTPKSDEFNPCEDIMGYRFLRIVVWFVSLLALLGNVFVLVILLTSHYKLTVPRFLMCNLAFADFCMGMYLLLIASVDLYTQSEYYNHAIDWQTGPGCNTAGFFTVFASELSVYTLTVITLERWYAITFAMRLDRKIRLRHAYAIMAGGWVCCFLLALLPLVGISSYAKVSICLPMDTETPLALAYIILVLLLNIVAFTIVCSCY

SEQ ID NO: 470 - protein, 176 aa, Sus scrofa
NTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYARIWSKLKNHVSPGGVNDHYHQRRQKTTKMLVCVVV

SEQ ID NO: 471 - protein, 101 aa, Sus scrofa
FNILTSNRKTLTPEKGQSQGLIWDFGYLTLMEQRSGGAGKGNNKGPLGVTEELHIISFTVKYTYQGLKQELTTDTLPVVIISNMNQLSIAWASILWFNLLS

SEQ ID NO: 472 - protein, 76 aa, Capra hircus
HETGSNNPTGIPSDTDKIPFHPYYTIKDILGAMLLILVLMLLVLFTPDLLGDPDNYTPANPLNTPPHIKPEWYFLF

SEQ ID NO: 473 - protein, 76 aa, Sus scrofa
SPLPPLFLPTDPPMVWLLAKCWVRSSDFQLHELHSHLLRGHLMAEVIAVATMRCLPSIHPIFKLLIPHFRYTMEIN

SEQ ID NO: 474 - protein, 201 aa, Sus scrofa
MWNATPSEEPGPNLTLPDLGWDAPPENDSLVEELLPLFPTPLLAGVTATCVALFVVGIAGNLLTMLVVSRFREMRTTTNLYLSSMAFSDLLIFLCMPLDLFRLWQYRPWNLGNLLCKLFQFVSESCTYATVLTITALSVERYFAICFPLRAKVVVTKGRVKLVILVIWAVAFCSAGPIFVLVGVEHDNGTDPRDTNECRAT

SEQ ID NO: 475 - protein, 201 aa, Sus scrofa
DSEEDHEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLITSSLMLLFLFTYIYLGEVLKTYNVAMDYPTLFLTVWNFGAVGMVCIHWKGPLVLQQAYLIMISALMALVFIKYLPEWS

SEQ ID NO: 476 - protein, 151 aa, Sus scrofa
NEEDLRECFFDDVESIPTVTTWNTYLRYVTVHKSLIFVLIWCLVVFLAEVAACLVVLCLLKKTSPQDKGNSTKGANNSYAVIITSTSAYYVFYIYVGVADGLLALGLFRGLPLVHTLITVSKILHRKMLHSVLQAPMSTLNTLKAGGILNR

SEQ ID NO: 477 - protein, 126 aa, Sus scrofa
LNGTSALPHSAANDPVFVVLHSFTDAIFDEWMKRFSPPVDAWPQELAPIGHNRMYNMVPFFPPVTNEELFLTADQLGYSYAIDLPVSVEGTPDWTTTLSVVMGMLVVLVGLSALLLFLQYRRLRKG

SEQ ID NO: 478 - protein, 226 aa, Sus scrofa
FKEEIGIAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMPFFTTVLSIDIRRMELADLNKRLPPEACLPPAKPVGRSARFERQLAVRPATPHTITLQPSSFRNLRLP

SEQ ID NO: 479 - protein, 76 aa, Sus scrofa
WWLFSFYFCLPLAITAFFYTLMTCEMLRKKSGMQIALNDHLKQRREVAKTVFCLVLVFALCWLPLHLSRILKLTLY

SEQ ID NO: 480 - protein, 151 aa, Solanum tuberosum
QKDTYLNYSQALSYTSQALSQNLQGLRKRSPIRRMSTKLVYSLQENWKRIWVLVLWILIMIGLFLWKFYLYKQKSAFQVMGYCLLTAKGAAETLKFNMALILLPVCRNTITFLRSTKLSCFVPFDDNINFHKTVAAAIVTGIILHAGNHLV

SEQ ID NO: 481 - protein, 126 aa, Solanum tuberosum
MIIDTTEIETINSFSKLESLKEVYGIIWMLVPIVTLVLGITIGVLVIVWLEREISAGIQQRIGPEYAGPLGILQALADGTKLLLKENLIPSTGDTRLFSIGPSIAVISIFLSYSVIPFGDHLVLAD

SEQ ID NO: 482 - protein, 101 aa, Sus scrofa
LILAFISLDRYLAIVHATNSQRPRKLLAEKVVYVGVWIPALLLTIPDFIFANVREGDGRYICDRFYPNDLWLVVFQFQHIMVGLILPGIVILSCYCIIISK

SEQ ID NO: 483 - protein, 76 aa, Sus scrofa
LILYVLPLGIISFSYARIWSKLKNHVSPGGVNDHYHQRRQKTTKMLVCVVVVFAVSWLPLHAFQLAVDIDSQVLDL

SEQ ID NO: 484 - protein, 151 aa, Sus scrofa
ALVYLPGVIAAIVQLHNGTKYKKFPHWLDRWMVTRKQFGLLSFFFAVLHAVYSLSYPMRRSYRYKLLNWAYQQVQQNKEDAWIEHDVWRMEIYVSLGIVTLAILALLAVTSIPSVSDSLTWREFHYIQSTLGIVSLLLGTIHALIFAWNKW

SEQ ID NO: 485 - protein, 101 aa, Sus scrofa
TTALLFTPVTIRLCEVLNLDPRQVLIAEVIFTNIGGAATAIGDPPNVIIVSNQELRKMGLDFAGFTAHMFAGICFVLLFSFPLLRLLYWNRKLYNKEPSEI

SEQ ID NO: 486 - protein, 76 aa, Solanum tuberosum
RGGLDPVTGGLWLTDIAHHHLAIAILFLIAGHMYRTNWGIGHGLKDILEAHKGPFTGQGHKGLYEILTTSWHAQLS

SEQ ID NO: 487 - protein, 76 aa, Solanum tuberosum
LGFSSSEMHELLMRLYVTIHSDHEGGNVSAHTGHLVASALSDPYLSFAAALNGLAGPLHGLANQEVLLWIKSVVEE

SEQ ID NO: 488 - protein, 101 aa, Sus scrofa
AAVVLLLSALVLRAPPSVGYLDRLPRSFHLTQESAKIVGSPNFPVKVYVMLHQKSPHVLCVTQRLRNFELVDPSFQWHGPKGKIVSENSTAQVTSTGSLVF

SEQ ID NO: 489 - protein, 76 aa, Capra hircus
MWVLLGVFLLTLAYLFWPKTKHSAAKYPRSLPSLPLVGSLLFLPRRGQQHENFFKLQEKYGPIYSFRLGSKTTVMI

SEQ ID NO: 490 - protein, 226 aa, Sus scrofa
SKQCESTARRPNNETLYSAIFAESELSDWDYDYGFCSPKTLQCAPEPDAFNPCEDIMGYDFLRVLIWLINILAIMGNVTVLFVLLTSHYKLTVPRFLMCNLSFADFCMGLYLLLIASVDAQTKGQYYNHAIDWQTGNGCSVAGFFTVFASELSVYTLTVITLERWHTITYAIQLDQKLRLRHAIPIMLGGWLFSTLIAMLPLVGVSSYMKVSICLPMDVETTLSQV

SEQ ID NO: 491 - protein, 276 aa, Sus scrofa
LRYLSLAHNDIHSRVSQQLCSASLCALDFSGNDLSRMWAEGDLYLRFFQGLRSLVWLDLSQNHLHTLLPRALDNLPKSLKHLHLRDNNLAFFNWSSLTLLPKLETLDLAGNQLKALSNGSLPSGTQLRRLDLSGNSIGFVNPGFFALAKQLEELNLSANALKTVEPSWFGSMVGNLKVLDVSANPLHCACGATFVGFLLEVQAAVPGLPSRVKCGSPGQLQGHSIFAQDLRLCLDETLSWNCFGISLLAMALGLVVPMLHHLCGWDLWYCFHLCLA

SEQ ID NO: 492 - protein, 126 aa, Sus scrofa
MNYTESSPLAESTAIGFTPELGSITPVPSNETTCENWREIHHLVFHVANVFFAIGLVLPTTLHLHMILLRGMLTIGCTLYIVWATLYRCALDIMIWNSVFLGINVLHLSYLLYKKRPVKIEKELKG

SEQ ID NO: 493 - protein, 126 aa, Solanum tuberosum
AYASRTLLFLQDNGSLKPLAIELSFPHPDGDQFGVTSKVYTPSDQGVESSIWQLAKAYVAVNDVGVHQLISHWLNTHAVIEPFVIATNRQLSVLHPIHKLLYPHFRDTMNINASARQLLVNAGGVL

SEQ ID NO: 494 - protein, 251 aa, Sus scrofa
ISFMAERSIEDELNRESNSDLFTILISYAIMFLYISIALGHIKSCSRLLVDSKISLGIAGILIVLSSVACSLGIFSYIGVPLTLIVIEVIPFLVLAVGVDNIFILVQTYQRDERLQGETLDQQLGRVLGEVAPSMFLSSFSETVAFFLGGLSVVPAVHTFSLFAGMAVLIDFLLQITCFVSLLGLDIKRQEKNRLDVVCCVQGAEDGAGVQASESCLFRFFKNSYAPLLLKDWMRPIVIAVFVGVLSFSIA

SEQ ID NO: 495 - protein, 101 aa, Solanum tuberosum
MGVTKKPDLNDPVLRAKLAKGMGHNYYGEPAWPNDLLYIFPVVILGTIACNVGLAVLEPSMIGEPPDPFATPLEILPEWYFFPVFQILRTVPNKLLGVLLM

SEQ ID NO: 496 - protein, 251 aa, Sus scrofa
NEEDLRECFFDDVESIPTVTTWNTYLRYVTVHKSLIFVLIWCLVVFLAEVAACLVVLCLLKKTSPQDKGNSTKGANNSYAVIITSTSAYYVFYIYVGVADGLLALGLFRGLPLVHTLITVSKILHRKMLHSVLQAPMSTLNTLKAGGILNRFSKDIAVLDDLLPLTIFDFIQLLLIVIGAVAVVSVLKPYIFLATVPVIVAFILLRAYFLHTSQQLKQLESEGRSPIFTHLITSLKGLWTLRAFGRQPYFE

SEQ ID NO: 497 - protein, 76 aa, Sus scrofa
YRAQVFASIFLLLLSPAGVGARAKNDFNLVHPLVTMEQLLWVSGKQIGSVDTFRIPLITTTPRGTLLAFAEARKMS

SEQ ID NO: 498 - protein, 151 aa, Sus scrofa
GGGGHADCEELQRTGRFCGGLIKDIKRKAPFFASDFYDALNIQALSAILFIYLATVTNAITFGGLLGDATDNMQGVLESFLGTAVSGAVFCLFAGQPLTILSSTGPVLVFERLLFNFSKDHNFDYLEFRLWIGLWSAFLCLILVATDASFL

SEQ ID NO: 499 - protein, 76 aa, Capra hircus
VLFIYGVSDLPSDHQMMLTVRVHTWSSLELVCSELTNPFVMKAGESVVLYSKPVPELLKGCPGCTRQSCVVSFYLS

SEQ ID NO: 500 - protein, 251 aa, Solanum tuberosum
QKDTYLNYSQALSYTSQALSQNLQGLRKRSPIRRMSTKLVYSLQENWKRIWVLVLWILIMIGLFLWKFYLYKQKSAFQVMGYCLLTAKGAAETLKFNMALILLPVCRNTITFLRSTKLSCFVPFDDNINFHKTVAAAIVTGIILHAGNHLVCDFPKLIHANNTNYQKYLVNDFGPSQPQYIDLVKGVEGVTGIIMVILMAIAFTLATRWFRRSLIKFPKPFDRLTGFNAFWYSHHLLIIVYIVLIIHGTFL

SEQ ID NO: 501 - protein, 76 aa, Sus scrofa
NLQKEISLAKARHGIADLFRTPVLRRVTLCLSLAWFATGFAYYSLAMGVEEFGVNLYVLQLIFGGVDVPAKFITML

SEQ ID NO: 502 - protein, 101 aa, Sus scrofa
MATMVAQKLSHLLPSLRQVHPEPQPSVHPEPVFTVDRAEVPPLFWKPYIYVGYRPLHQTWRFYFRTLFQQHNEAVNVWTHLLAALVLLLRLAIFVGTVDFW

SEQ ID NO: 503 - protein, 76 aa, Sus scrofa
MLLTLYACLLWLSTSGLWTSQAKDPDSDLSTRSRHRNLAPNNVDFAFALYKHLVASAPGKDVFLSPVSISTALAML

SEQ ID NO: 504 - protein, 101 aa, Malus domestica
LDGLYEQINITRDTTDYLWYMTDITIGSDEAFLKNGKSPLLTIFSAGHALNVFINGQLSGTVYGSLENPKLSFSQNVNLRSGINKLALLSISVGLPNVGTH

SEQ ID NO: 505 - protein, 151 aa, Capra hircus
IVHATQFYRRGPPARVALTCVAVWGLCLLFALPDFIFLSSHHDNRLNATHCQYNFPQEGRTALRVLQLVAGFLLPLLVMAYCYARILTVLLVSRGQRRLRAMRLVVVVVVAFALCWTPYHLVVLVDTLMDLGALARNCGRESRVDVAKSVT

SEQ ID NO: 506 - protein, 251 aa, Sus scrofa
LAVSSGSASTEKGELLDSAHIRCHLSKLRCCVQWLKVSGLFVFVVLCSILFSLYPDQGKFWQLLAVSPLESYSVNLSSHADSMLLQVDLAGALVASGPSHLGKEEHVAVEVTQANAPGSRRRRPQQVTHNWTIFLNPSGGEHTVMSRTFEVLSREPVSINIRASLQQTQIVPLLMAHQYLRASIEAQVTIAAVILAGVYVLIIFEIVHRTLAAMLGSLAALAALAVIGDRPTLTQVVEWIDFETLALLFGM

SEQ ID NO: 507 - protein, 151 aa, Sus scrofa
MLSRLFRMHGLFVASHPWEVIVGTVTLTICMMSMNMFTGNDKICGWNYECPKFEEDVLSSDIIILTITRCIAILYIYFQFQNLRQLGSKYILGIAGLFTIFSSFVFSTVVIHFLDKELTGLNEALPFFLLLIDLSRASALAKFALSSNSQD

SEQ ID NO: 508 - protein, 126 aa, Sus scrofa
TLMDHWVFGEVMCKLNPFVQCVSITVSIFSLVLIAVERHQLIINPRGWRPSNRHAYVGIAVIWVLAVASSLPFLIYQVLTDEPFQNVTLDAFKDKYVCFDKFLSDSHRLSYTTLLLVLQYFGPLCF

SEQ ID NO: 509 - protein, 176 aa, Sus scrofa
FVGLGYRKTVAILYQTAFSVGLVLLSGLAYAVPHWRSLQLAVSLPIFLLLLCYWFVPESPRWLLSQKRNTQAIKIMDRIAQKNGKLPPADLKMLSLEEEVVTERLSPSFLDLFRTQNLRKYTFILMYLWFTSSVLYQGLIMHVGATGGSLYLDFLYSALVEFPAAFVILLIIDRFG

SEQ ID NO: 510 - protein, 201 aa, Sus scrofa
LLCQRLAARLGVVTGKDLGEICHLYYPKVPRTLLWLNMELAIVGSDMQEVIGTAIAFNLLSAGRIPLWGGVLITVVDTFFFLYLNNYGLRKLEAFFAFLIAIMAFTFGYEYVVARPAQGALLRGLFLPSCSGCGQPELLQAVGIVGAIIMPHNIYLHSALVKSREVDRTRREDIREANMYFLIESTIALFVSFFINLFVMA

SEQ ID NO: 511 - protein, 126 aa, Sus scrofa
MLLWSGICGLSPPRIFPSLLVVVALVGLLPVLRSHGLQPSPTASTIRGSEPPRERSIGDVTTAPPELAPESRPVNHSVTEHGMKARKAFPVLGIDYTHVRTPFEISLWILLACLMKIGFHVIPTIS

SEQ ID NO: 512 - protein, 226 aa, Sus scrofa
PIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKD

SEQ ID NO: 513 - protein, 176 aa, Sus scrofa
MEHLERCAWVLRGTLVRAAVRRYLPWALAASMLAGSLLKELSPLPESYLSNKRNVLNVYFVKVAWAWTFCLLLPFIALTNYHLTGKAGLVLRRLSTLLVGTAIWYVCTAIFSNVEHYTGSCYQSPALEGVRNEPLSKQQCHGQGGFWHGFDISGHSFLLTFCALMIVEEMAVLHEV

SEQ ID NO: 514 - protein, 151 aa, Sus scrofa
VGLVAVFDYHRKKGIADLYSLHSWCGILVFVLFLAQWLVGLGFFLFPGASFSLRSRYRPQHVFFGAAIFLLSVGTALLGLKEALLFQLGTKYSAFESEGVLANVLGLLLVAFGAVVLYILTRADWKRPLQAEEQALSMDFKTLTEGDSPSS

SEQ ID NO: 515 - protein, 76 aa, Capsicum annuum
LRVGVIHGLARMAAIMASAYKAYLGVGLGPLSFITKFRIPHPGRVGGRFFIDLGMPLMLSWVLGGNGEKLEGRIQH

SEQ ID NO: 516 - protein, 101 aa, Sus scrofa
IQFVDMVKGRSLAGVVNAQALTSAFSPHTKPWIGLAEALGALMQAWAGSPKGTIQVVTQGTSLKNSGTCLSPAVIVGLLKEASHRADVNLVNAKLLEKEAG

SEQ ID NO: 517 - protein, 276 aa, Sus scrofa
DAAVDFHRLIASTAIILTVLHSAGHVVNVYLFSISPLSVLSCLFPGLFHDNGSEFPQKYYWWFFQTVPGLTGVMLLLILAIMYVFASHHFRRCSFRGFWLTHHLYILLYMLLIIHGSFALIQLPRFHIFFLVPALIYVGDKLVSLSRKKVEISVVKAELLPSGVTHLQFQRPQGFEYKSGQWVRIACLALGTTEYHPFTLTSAPHEDTLSLHIRAAGPWTTRLREIYSPPTDDNCAKYPKLYLDGPFGEGHQEWHKFEVSVLVGGGIGVTPFASIL

SEQ ID NO: 518 - protein, 276 aa, Sus scrofa
DFFFVYADYHTHFLYCVRAPASLNDASLLHDPCLGTFGGPVFPWLVLGGYDDQNYNNATALVITFPVNNYYNDTEKLQRAQAWESEFINFVKNYKNPNLTISFMAERSIEDELNRESNSDLFTILISYAIMFLYISIALGHIKSCSRLLVDSKISLGIAGILIVLSSVACSLGIFSYIGVPLTLIVIEVIPFLVLAVGVDNIFILVQTYQRDERLQGETLDQQLGRVLGEVAPSMFLSSFSETVAFFLGGLSVVPAVHTFSLFAGMAVLIDFLLQI

SEQ ID NO: 519 - protein, 276 aa, Sus scrofa
KGEAPAKSSTHRHDEELGMASAETLTVFLKLLAAGFYGVSSFLIVVVNKSVLTNYRFPSSLCVGLGQMVATVAVLWVGKALRVVKFPDFDRNVPRKTFPLPLLYFGNQITGLFSTKKLNLPMFTVLRRFSILFTMFAEGVLLKKTFSWGIKMTVFAMIIGAFVAASSDLAFDLEGYVFILINDVLTAANGAYVKQKLDSKELGKYGLLYYNALFMILPTLAIAYITGDAQKAMDFEGWADTLFLLQFTLSCVMGFILMYATVLCTQYNSALTTTIV

SEQ ID NO: 520 - protein, 176 aa, Sus scrofa
MHMFRDPATGDLPWTGMTFGLTIMATWYWCTDQVIVQRSLSARDLNHAKGGSILASYLKMLPMGLMVMPGMISRVLFPDDVGCVVPSECLRACGAEIGCSNIAYPKLVMELMPTGLRGLMVAVMMAALMSSLTSIFNSSSTLFTMDVWRRLRPRAGERELLLVGRLVIVVLIGVSV

SEQ ID NO: 521 - protein, 151 aa, Sus scrofa
MDRGVLPQAIALLLAVCSFGPTAGLAEGVQCDLQPVDPKVTYTTSQVSEGCVAHVPNATVGVHILFLEFSKEVSTLELTVQMTNPNGARPQEVLLILSVNKNIHLTLQVPEIPLHLAYDSKLVFLQEAPKAVITELPPSTTKNQLFLWANT

SEQ ID NO: 522 - protein, 76 aa, Sus scrofa
KSSVGTSLLLNLAQILSDMVIKGQFKPSRSIVFASWSAGDFGAIGATEWLEGYLSSLHLKAFTYINLDKAVLGTSN

SEQ ID NO: 523 - protein, 76 aa, Sus scrofa
AVFRPEVPLRRGLPLLLFRAQPSNPTMLPTMIGLLAEARVQLLSYQTSVVSDGETWHVMAISSLLPSLEPWKQHVT

SEQ ID NO: 524 - protein, 176 aa, Solanum tuberosum
MIWHVQNENFILDSTRIFMKAFHLLLFDGSLIFPECILIFGLILLLMIDSTSDQKDIPWLYFISSTSLVLSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRS

SEQ ID NO: 525 - protein, 176 aa, Solanum tuberosum; identical to SEQ ID NO: 524

SEQ ID NO: 526 - protein, 226 aa, Sus scrofa
LGKEEHVAVEVTQANAPGSRRRRPQQVTHNWTIFLNPSGGEHTVMSRTFEVLSREPVSINIRASLQQTQIVPLLMAHQYLRASIEAQVTIAAVILAGVYVLIIFEIVHRTLAAMLGSLAALAALAVIGDRPTLTQVVEWIDFETLALLFGMMILVAIFSETGFFDYCAVKAYQLSRGRVWAMIIMLCLIAAVLSAFLDNVTTALLFTPVTIRLCEVLNLDPRQVLI

SEQ ID NO: 527 - protein, 101 aa, Sus scrofa
LLRAVSYHLVQKPFTLTKSILLDLAYAYGKLGFHQTQVFQRLAADLLPHTPSLTSSEVARCTKSFAFLKWLSLPLFEAFAQHVLDRAQSIALPHLCNMLLA

SEQ ID NO: 528 - protein, 101 aa, Sus scrofa
THHLYILLYMLLIIHGSFALIQLPRFHIFFLVPALIYVGDKLVSLSRKKVEISVVKAELLPSGVTHLQFQRPQGFEYKSGQWVRIACLALGTTEYHPFTLT

SEQ ID NO: 529 - protein, 251 aa, Sus scrofa
VYDTPGSSIVTEFNLVCEAAWKVDLFQSCVNVGFFVGSMGIGYIADRLVGSSASWPPPHQCRLGRPDAVAPDYVSLLVFRLLQGLVSKGSWMAGYTLITEFVGLGYRKTVAILYQTAFSVGLVLLSGLAYAVPHWRSLQLAVSLPIFLLLLCYWFVPESPRWLLSQKRNTQAIKIMDRIAQKNGKLPPADLKMLSLEEEVVTERLSPSFLDLFRTQNLRKYTFILMYLWFTSSVLYQGLIMHVGATGGSLY

SEQ ID NO: 530 - protein, 126 aa, Solanum tuberosum
FHYHKAAPKLAWFQDVESMLNHHLAGLLGLGSLSWAGHQVHVSLPINQFLNAGVDPKEIPLPHEFILNRDLLAQLYPSFAEGATPFFTLNWSKYADFLTFRGGLDPVTGGLWLTDIAHHHLAIAIL

SEQ ID NO: 531 - protein, 251 aa, Solanum tuberosum
MEGVLQTRGLLSLPSKPKIKAFYPLPQGGLRNRFNSLSSLKPNPLNGVSLSSNGFQKVQGFDTKPQLFGQKKRCFPICKAEAAAAAGAADGQPLFVEKEQPKFMGIELVTLKKIIPLGAMFFCILFNYTILRDTKDVLVVTAKGSSAEIIPFLKTWVNLPMAIGFMLLYTKLANVLSKEALFYTVILPFIAFFGAFGFVLYPLSNYFHPTAFADKLLNTLGPRFLGPIAILRIWSFCLFYVMAELWGSVVV

SEQ ID NO: 532 - protein, 251 aa, Sus scrofa
PDFDAAEKVTKYCGEDGDWYRHPESNISWSNYTMCNAFTPDKLQNAYILYYLAIVGHSLSILTLLISLGIFMFLRYFNLLAPFNALLYPTRSISCQRVTLHKNMFLTYVLNSIIIIVHLVVIVPNGELVKRDPPICKVLHFFHQYMMSCNYFWMLCEGVYLHTLIVVSVFAEGQRLWWYHVLGWGFPLIPTTAHAITRAVLFNDNCWLSVDTNLLYIIHGPVMAALVVNFFFLLNILRVLVKKLKESQEAE

SEQ ID NO: 533 - protein, 126 aa, Sus scrofa
TFLGGFVLLVVFLATRRVAVTARHLSRLVVGAAVWRGAGRAFLLIEDLTGSCFEPLPQGLLLHELPDRRSRLAAGHQWRGYTVSSHTFLLTFCCLLMAEEAAVFAKYLAHGLPAGAPLRLVFLLNV

SEQ ID NO: 534 - protein, 101 aa, Sus scrofa
AFILLRAYFLHTSQQLKQLESEGRSPIFTHLITSLKGLWTLRAFGRQPYFETLFHKALNLHTANWFLYLSTLRWFQMRIEMIFVIFFIAVTFISILTTGEG

SEQ ID NO: 535 - protein, 126 aa, Sus scrofa
ATPRGQVVVLACPLIFKLFSPTQGLNVSRNCTDEGWTPLEPGPYPIACGMDDKASGLDEQQTVFYNSVKTGYTIGYSLSLAALLVATAILSLFRKLHCTRNYIHMHLFISFILRATAVFIKDLALF

SEQ ID NO: 536 - protein, 76 aa, Sus scrofa
KGEAPAKSSTHRHDEELGMASAETLTVFLKLLAAGFYGVSSFLIVVVNKSVLTNYRFPSSLCVGLGQMVATVAVLW

SEQ ID NO: 537 - protein, 126 aa, Solanum tuberosum
EQNEDNVLARMLDHKEAIISHLSWASLFLGFHTLGLYVHNDVMLAFGTPEKQILIEPIFAQWIQSAHGKTSYGFDVLLSSTTGPAFNAGRSIWLPGWLNAVNENSNSLFLTIGPGDFLVHHAIALG

SEQ ID NO: 538 - protein, 276 aa, Sus scrofa
VMTIFLVVLYKYRCYKFIHGWLITSSLMLLFLFTYIYLGEVLKTYNVAMDYPTLFLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLPGYPGEELEEEEERGVKLGLGDFIFYSVLVGKAAATGSGDWNTTLACFVAILIGLCLTLLLLAVFKKALPALPISITFGLIF

SEQ ID NO: 539 - protein, 76 aa, Sus scrofa
LFNDNCWLSVDTNLLYIIHGPVMAALVVNFFFLLNILRVLVKKLKESQEAESHMYLKAVRATLILVPLLGVQFVVL

SEQ ID NO: 540 - protein, 126 aa, Sus scrofa
PIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDP

SEQ ID NO: 541 - protein, 76 aa, Solanum tuberosum
GPCVCLAKGAAETIKLNMAIILLPVCRNTITWLRNKTRLGSAVPFDDNLNFHKVIAVAIALGVAIHGLAHLTCDFP

SEQ ID NO: 542 - protein, 201 aa, Salmo salar
KCLFAFYGGETVYHKYLIGLQFYNVFLFFWCANFVTALGQMTLAGAFASYYWALVKPDDMPAFPIFSSLGRSLRYHTGSLAFGSLILSIIQIIRVLLEYIDHKLQGTQNKCTKFLLCCLKCCFWCLEKFIKFINRNAYIMVAIYGKNFCTSAKDAFFLLMRNMIRVAVLDKVTDFLLFLGKLLIVGLVGIFAFFFFSGRVK

SEQ ID NO: 543 - protein, 76 aa, Thunnus albacares
MFKLVAQLYKIVPNVLLEQGKAKNPWPNVDAHSGVLLQYYGMTEMNYYTVLFGVSRALGVLAQLVWSRALGFPLER

SEQ ID NO: 544 - protein, 76 aa, Meleagris gallopavo
FNKTDWIFGDVMCKLQRFIFHVNLYGSILFLTCISVHRYTGVVHPLKSLGRLKKKNAVYVSSLVWALVVAVIAPIL

SEQ ID NO: 545 - protein, 76 aa, Solanum tuberosum
PHNNQQQEDNNTLLIDASDALPLPLYLTNGLFFTMFFSVMYFLLSRWREKIRNSTPLHVVTLSELGAIVSLIASVI

SEQ ID NO: 546 - protein, 126 aa, Sus scrofa
EGDPGEPLCKILLVLYSVGLFSEAFFNVLLTVQRYQKFFQMRGFFSATRMVAGSIFPSALVWVIAVLVMLPELAFYKPQMENQKYKCFFGRPLFLPADETFWKHFLTLKMNILGFLLPLFVFVFCY

SEQ ID NO: 547 - protein, 76 aa, Solanum tuberosum
MIFSTLEHILTHISFSIVSIVITIHLITFLVDEIVKLYDSSEKGIIVTFFCITGLLVTRWISSGHFPLSDLYESLI

SEQ ID NO: 548 - protein, 76 aa, Sus scrofa
SVAAARIFYKLMLRLGFQEFYLQGGDWGSLICTNMAQLVPSHVKGLHLNVALVLRNVYTLTFFLGRRLGRLFGYTE

SEQ ID NO: 549 - protein, 101 aa, Sus scrofa
MGNGTWEGCHVDSRVDHLFPPSLYIFVIGVGLPTNCLRLWAAYRQVRQRNELGVYLMNLSIADLLYICTLPLWVDYFLHHDNWIHGPGSCKLFGFIFYTNI

SEQ ID NO: 550 - protein, 226 aa, Sus scrofa
IYTDALQTLIMLIGALTLMGYSFAAVGGMEGLKEKYFLALASNRSGNSSCGLPREDAFHIFRDPLTSDLPWPGILFGMSIPSLWYWCTDQVIVQRTLAAKNLSHAKGGSLMAAYLKVLPLFIMVFPGMVSRVLFPDQVACADPEICQKVCSNPAGCSDIAYPKLVLELLPMGLRGLMMAVMVAALMSSLTSIFNSASTIFTMDLWNHLRPRASERELMIVGRVFVL

SEQ ID NO: 551 - protein, 76 aa, Sus scrofa
NYIHMHLFISFILRATAVFIKDLALFDSEESDHCSKGSVGCKAAVVLFQYCVMANFFWLLVEGLYLHTLLAVSFFS

SEQ ID NO: 552 - protein, 76 aa, Sus scrofa
MRLRWTQGGNMWLGVLLTLQLCSSLEGQENSFTINSIHMEMLPGQEVHNGENLTLQCIVDVSTTSSVKPQHQVLFY

SEQ ID NO: 553 - protein, 176 aa, Sus scrofa
WMLVFRLIQGLVSKAGWMIGYILITEFVGLSYRRTVGIFYQVAFTFGLLVLAGVAYALPHWRWLQFTVTLPNFCFLFYYWCVPESPRWLISQNKNAKAMSIIKHIAKKNGKSLPASLQSLRPDEEVGEKLKPSFLDLVRTPQIRKHTLILMYNWFTSAVLYQGLVMHMGLAGSNLY

SEQ ID NO: 554 - protein, 76 aa, Sus scrofa
FWKHFLTLKMNILGFLLPLFVFVFCYVRMRRTLKFGERGYDLFKLVFTIMVVFLLMWGPYNIALFLSAFNEHFSLH

SEQ ID NO: 555 - protein, 126 aa, Sus scrofa
LLGRIIASYDPDNKAERSIAIYLGVGLCLLFIVRTLLLHPAIFGPHHIGMQMRIAMFSLIYKKTLKLSSRVLDKISIGQLVSLLSNNLNKFDEGLALAHFVWIAPLQVTLLMGLLWELLQASAFCG

SEQ ID NO: 556 - protein, 101 aa, Sus scrofa
PQHLVKAGFMTPSEHKHLEKLSLPHNSFWMPWVWFANLSTKAWIGGRIRDPVLLQSLLDEMNTLRTQCGHLYAYDWISVPLVYTQVVTVAVYSFFLACLVG

SEQ ID NO: 557 - protein, 101 aa, Sus scrofa
MARTVCGCSWALIFIIMSLLVKAKIDVCKRGDVTVQPSHVISLGSAVNISCSLKPRQGCLQVSSLNKLILYRFHRRIHFQRGHSLSSQVTGLPLGTTLFVC

SEQ ID NO: 558 - protein, 201 aa, Sus scrofa
MANSASPEQNQNHCSAINSSILLTQGNLPTLTLSGKIRVTVTFFLFLLSTAFNASFLLKLQKWTQRKEKGKKLSRMKVLLKHLTLANLLETLIVMPLDGMWNITVQWYAGEFLCKVLSYLKLFSMYAPAFMMVVISLDRSLAITRPLAVKSNSRLGRFMIGLAWLLSSIFAGPQLYIFRMIHLADSSGQTEGFSQCVTHGS

SEQ ID NO: 559 - protein, 126 aa, Meleagris gallopavo
MDPLNLSWYNTGDRNWSEPVNESSADQKPQYNYYAVLLTLLIFVIVFGNVLVCMAVSREKALQTTTNYLIVSLAVADLLVATLVMPWVVYLEVVGEWRFSRIHCDIFVTLDVMMCTASILNLCAIS

SEQ ID NO: 560 - protein, 101 aa, Sus scrofa
ALGRSFVHGPELDNGQLRIQRTGIYRLHIQVTLTNCSSSTWTVMPRQATLTLGICSPTTHSISLLRLNFHHTCRVASQRLTPLAKGDVLCTNLTLPLLPSR

SEQ ID NO: 561 - protein, 251 aa, Sus scrofa
MAFEELLDKVGGFGPFQLWNVALLALPRVLLPMHFLLPIFLTAVPAHRCALPGAPANFSHQDAWLEAHLPREPDGRFSSCLRFTHSRALPNTTLWGLGQSPGEQLEGEPSTVPCPQGWEYDHSEFSSTIATEWDLVCEQKGLNRATSTFFFAGVLVGAVAFGYLSDRFGRRRLLLVAYVSALVLGLVSAASVSYTMFAITRTLTGTALAGFTIIVMPLELEWLDVGHRTVAGVLSSTFWTGGVMLLALVGY

SEQ ID NO: 562 - protein, 226 aa, Sus scrofa
MEGVLAANWSAEAVNSSAAPPEAEGNRTAGPPQRNEALARVEVAVLCLILFLALSGNACVLLALRTTRHKHSRLFFFMKHLSIADLVVAVFQVLPQLLWDITFRFYGPDLLCRLVKYLQVVGMFASTYLLLLMSLDRCLAICQPLRALRRPADRLAVLATWLGCLVASAPQVHIFSLREVADGVFDCWAVFIQPWGPKAYITWITLAVYIVPVIVLAACYGLISFK

SEQ ID NO: 563 - protein, 201 aa, Sus scrofa
MERGPVVGAGLGARARIRTLLGCLVKVLLWVASALLYFGSEQAARLLGSPCLRRLYHAWLAAVVIFGPLLQFHVNPRTIFASHGNFFNIKFVNSAWGWTCTFLGGFVLLVVFLATRRVAVTARHLSRLVVGAAVWRGAGRAFLLIEDLTGSCFEPLPQGLLLHELPDRRSRLAAGHQWRGYTVSSHTFLLTFCCLLMAEEA

SEQ ID NO: 564 - protein, 276 aa, Sus scrofa
WMLVFRLIQGLVSKAGWMIGYILITEFVGLSYRRTVGIFYQVAFTFGLLVLAGVAYALPHWRWLQFTVTLPNFCFLFYYWCVPESPRWLISQNKNAKAMSIIKHIAKKNGKSLPASLQSLRPDEEVGEKLKPSFLDLVRTPQIRKHTLILMYNWFTSAVLYQGLVMHMGLAGSNLYLDFFYSALVEFPAALLILLTIDRLGRRHPWAASNVVAGAACLASVFIPEDPHWLRITVLCLGRMGITMAYEMVCLVNAELYPTFIRNLGVLVCSSMCDIG

SEQ ID NO: 565 - protein, 76 aa, Solanum tuberosum
LGTADFLVHHIHAFTIHVTVLILLKGVLFARSSRLIPDKANLGFRFPCDGPGRGGTCQVSAWDHVFLGLFWMYNSI

SEQ ID NO: 566 - protein, 76 aa, Sus scrofa
FGEVLCRVVNTMIYMNLYSSICFLMLVSIDRYLALVKTMSMGRMRGVRWAKLYSLVIWGCTLLLSSPMLAFRTMHE

SEQ ID NO: 567 - protein, 176 aa, Salmo salar
MRQLFKDYEVRQYVVQVVFSITFAFSCTMFELIIFEILGALETSSRYFHWKFNLYVILLVLIFVVPFYIGYFVVSNIRLLQRQKLLFACVVWFTFMYFFWKLGDPFPILSPKHGILSIEQLISRVGVIGVTLMALLSGFGAVNCPYTYMSYFLRNVTESDILALERRLLQTMDMIV

SEQ ID NO: 568 - protein, 101 aa, Sus scrofa
MEPNDSWRVDSEFRYTLFPIFYSIIFVLGVIANSYVLWVFARVYPSKKLNEIKIFMLNLTMADLLFLVTLPLWIIYYYHEGNWILPKFLCNLAGCFFFINT

SEQ ID NO: 569 - protein, 251 aa, Sus scrofa
GLLALGLFRGLPLVHTLITVSKILHRKMLHSVLQAPMSTLNTLKAGGILNRFSKDIAVLDDLLPLTIFDFIQLLLIVIGAVAVVSVLKPYIFLATVPVIVAFILLRAYFLHTSQQLKQLESEGRSPIFTHLITSLKGLWTLRAFGRQPYFETLFHKALNLHTANWFLYLSTLRWFQMRIEMIFVIFFIAVTFISILTTGEGEGTVGIILTLAMNIMSTLQWAVNSSIDVDSLMRSVSRVFKFIDMPAEGDQ

SEQ ID NO: 570 - protein, 76 aa, Sus scrofa
FWLLNVLFPPHTTPKAELSNHTRPVILVPGCLGNPDVVNWMCYRFTIWLDLNMFLPLGVDVPGFGKTYSVEYLDNS

SEQ ID NO: 571 - protein, 201 aa, Sus scrofa
IFGYLANRLGRRKVLILNYLQTAVSGTCAAFAPNFPVYCAFRLLSGMSLAGISLSCMTLNVEWMPIHTRACVGTLIGYVYSLGQFLLAGVAYAVPRWRHLQMLVSVPFFAFFIYSWFFIESARWYSSSGRLDLTLKALQRVAWINGKREEGASLSMEVLRASLNKELTMDKGQASAMELLRCPVLRRLFLCLSLLWFATSF

SEQ ID NO: 572 - protein, 276 aa, Sus scrofa
LPCPAFFSHFSSEPGALKRDCTTTGWSEPFPPYPEACPVPLELLTDEKSYFSTVRIVYTTGHSVSAVALFVAIAILVALRRLHCPRNYIHSQLFATFILKAGAVFLKDAALFHSENTDHCSFSTVLCKVSVATSHFATMTNFSWLLAEAVYLTCLLASTSPSTRRAFWWLVLAGWGLPLLFTGTWVGCKLAFEDVACWDLDDSSPYWWIIKGPIVLSVGVNFGLFLNIIRILLRKLEPAQGSLHTQPQYWRLSKSTLLLIPLFGIHYVIFNFLPDS

SEQ ID NO: 573 - protein, 276 aa, Sus scrofa
LGTYTSSMALKKFKTSRYFPTTARKLISDFAIILSILIFCVIDALVGVDTPKLIVPSEFKPTSPNRGWFVPPFGGNPWWVYLAAAIPALLVTILIFMDQQITAVIVNRKEHKLKKGAGYHLDLFWVAILMVVCSFMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIF

SEQ ID NO: 574 - protein, 126 aa, Sus scrofa
GRRHPWAASNVVAGAACLASVFIPEDPHWLRITVLCLGRMGITMAYEMVCLVNAELYPTFIRNLGVLVCSSMCDIGGIITPFLVYRLTDIWHELPLVVFAVVGLIAGGLVLLLPETKGKTLPETIE

SEQ ID NO: 575 - protein, 76 aa, Sus scrofa
LIIFEIVHRTLAAMLGSLAALAALAVIGDRPTLTQVVEWIDFETLALLFGMMILVAIFSETGFFDYCAVKAYQLSR

SEQ ID NO: 576 - protein, 126 aa, Sus scrofa
MGSEIPDYYNKTLASENNTVATRNSGFPVWEDYKGSVDDLQYFLIGLYTFVSLLGFMGNLLILMAVMRKRNQKTTVNFLIGNLAFSDILVVLFCSPFTLTSVLLDQWMFGKVMCHIMPFLQCVTVL

SEQ ID NO: 577 - protein, 251 aa, Sus scrofa
RSRRHQTVQQFKRFVENYRRHIGCLAVFYTIAGGLFLERAYYYAFAAHHMGITDTTRVGIILSRGTAASISFMFSYILLTMCRNLITFLRETFLNRYVPFDAAVDFHRLIASTAIILTVLHSAGHVVNVYLFSISPLSVLSCLFPGLFHDNGSEFPQKYYWWFFQTVPGLTGVMLLLILAIMYVFASHHFRRCSFRGFWLTHHLYILLYMLLIIHGSFALIQLPRFHIFFLVPALIYVGDKLVSLSRKKVE

SEQ ID NO: 578 - protein, 76 aa, Solanum tuberosum
TLAAWPVTRDSRLFHFLMLAMYSGQIGSFSSRDLLLFFIMWELELIPVYLLLAMWGGKKRLYSATKFILYTAGGSV

SEQ ID NO: 579 - protein, 76 aa, Solanum tuberosum
MIWHVQNENFILDSTRIFMKAFHLLLFDGSLIFPECILIFGLILLLMIDSTSDQKDIPWLYFISSTSLVLSITALL

SEQ ID NO: 580 - protein, 76 aa, Solanum tuberosum; identical to SEQ ID NO: 579

SEQ ID NO: 581 - protein, 151 aa, Sus scrofa
PGEQLEGEPSTVPCPQGWEYDHSEFSSTIATEWDLVCEQKGLNRATSTFFFAGVLVGAVAFGYLSDRFGRRRLLLVAYVSALVLGLVSAASVSYTMFAITRTLTGTALAGFTIIVMPLELEWLDVGHRTVAGVLSSTFWTGGVMLLALVGY

SEQ ID NO: 582 - protein, 101 aa, Sus scrofa
LAVSSGSASTEKGELLDSAHIRCHLSKLRCCVQWLKVSGLFVFVVLCSILFSLYPDQGKFWQLLAVSPLESYSVNLSSHADSMLLQVDLAGALVASGPSHL

SEQ ID NO: 583 - protein, 126 aa, Sus scrofa
RVVRRPSYVDLFRTPRLRHISLCCMVVWFGVNFSYYGLSLDVSGLGLNVYQTQLLFGAVELPSKLLVYLSVRHAGRRLTLAGTLLGTSLSLGFRLLVSSEMKSWSTALAVLGKGFSEAAFTTAYLF

SEQ ID NO: 584 - protein, 126 aa, Sus scrofa
MAALLLRHVGRHCLRAHLSPQLCIRNAVPLGTTAKEEMERFWNKNLGSNRPLSPHITIYRWSLPMAMSICHRGTGIALSAGVSLFGLSALLLPGNFESHLELVKSLCLGPTLIYTAKFGIVFPLMY

SEQ ID NO: 585 - protein, 151 aa, Sus scrofa
AGAVFLKDAALFHSENTDHCSFSTVLCKVSVATSHFATMTNFSWLLAEAVYLTCLLASTSPSTRRAFWWLVLAGWGLPLLFTGTWVGCKLAFEDVACWDLDDSSPYWWIIKGPIVLSVGVNFGLFLNIIRILLRKLEPAQGSLHTQPQYWR

SEQ ID NO: 586 - protein, 101 aa, Sus scrofa
FLDLQLNATEGNVSGPSVGNTSSPCEDMGIEVEVFLTLGLISLLENILVIGAIARNKNLHVPMYFFVCSLAVADMLVSLSNSWETITIYLIANKHLVLSDT

SEQ ID NO: 587 - protein, 126 aa, Sus scrofa
PDFDAAEKVTKYCGEDGDWYRHPESNISWSNYTMCNAFTPDKLQNAYILYYLAIVGHSLSILTLLISLGIFMFLRYFNLLAPFNALLYPTRSISCQRVTLHKNMFLTYVLNSIIIIVHLVVIVPNG

SEQ ID NO: 588 - protein, 101 aa, Salmo salar
RAPFDLTEGESELVSGFNVEYAGGPFALFFLAEYANILLMNTLSAILFLGASHIPAFPELTAVNLMTKAALLSVVFLWVRASYPRFRYDQLMHLVWKSFLP

SEQ ID NO: 589 - protein, 126 aa, Sus scrofa
NLSHAKGGSLMAAYLKVLPLFIMVFPGMVSRVLFPDQVACADPEICQKVCSNPAGCSDIAYPKLVLELLPMGLRGLMMAVMVAALMSSLTSIFNSASTIFTMDLWNHLRPRASERELMIVGRVFVL

SEQ ID NO: 590 - protein, 76 aa, Sus scrofa
LLCQRLAARLGVVTGKDLGEICHLYYPKVPRTLLWLNMELAIVGSDMQEVIGTAIAFNLLSAGRIPLWGGVLITVV

SEQ ID NO: 591 - protein, 76 aa, Sus scrofa
MWVLLVFFLLTLTYLFWPKTKGSGAKYPRSLPVLPVVGSLPFLPRRGHQHMNFFKLQDKYGPIFSFRLGSKTTVVI

SEQ ID NO: 592 - protein, 151 aa, Sus scrofa
MLTPFGALAAGFLAGTVSTLGFKFFTPILESKFKIQDTCGVHNLHGMPGVLGALLGVLVAGLATHDSYGEGLESVFPLIAEGQRSSTSQALHQLFGLFVTLIFASVGGGLGGLLLRLPFLDSPPDSQCYEDQIYWEVPEEHADLAQGSLRP

SEQ ID NO: 593 - protein, 151 aa, Sus scrofa
HKNMFLTYVLNSIIIIVHLVVIVPNGELVKRDPPICKVLHFFHQYMMSCNYFWMLCEGVYLHTLIVVSVFAEGQRLWWYHVLGWGFPLIPTTAHAITRAVLFNDNCWLSVDTNLLYIIHGPVMAALVVNFFFLLNILRVLVKKLKESQEAE

SEQ ID NO: 594 - protein, 76 aa, Sus scrofa
  MOD_RES (16)..(16): Any amino acid
MKLGSAIPWALLLSTXTLVSTAQNKGSDDCGGFLKNYSGWISYYKALTTNCVWTIEMKPGHKIILQILPLNLWTIE

SEQ ID NO: 595 - protein, 226 aa, Sus scrofa
MNSTLSSQVENHSIYYNFSEKNSQFLAFENDDCHLPLAMIFTLALAYGAVIILGVSGNLALIIIILKQKEMRNVTNILIVNLSFSDLLVAIMCLPFTFVYTLMDHWVFGEVMCKLNPFVQCVSITVSIFSLVLIAVERHQLIINPRGWRPSNRHAYVGIAVIWVLAVASSLPFLIYQVLTDEPFQNVTLDAFKDKYVCFDKFLSDSHRLSYTTLLLVLQYFGPLCF

SEQ ID NO: 596 - protein, 151 aa, Sus scrofa
GLLALGLFRGLPLVHTLITVSKILHRKMLHSVLQAPMSTLNTLKAGGILNRFSKDIAVLDDLLPLTIFDFIQLLLIVIGAVAVVSVLKPYIFLATVPVIVAFILLRAYFLHTSQQLKQLESEGRSPIFTHLITSLKGLWTLRAFGRQPYFE

SEQ ID NO: 597 - protein, 76 aa, Sus scrofa
RTSAQGILQGLHLGLGRGCGAMIGGVLVNYFGAAATFRGIGMACLVILLLFALIQWLAVPDEEEDKTMLAERIPVP

SEQ ID NO: 598 - protein, 226 aa, Sus scrofa
  MOD_RES (105)..(105): Any amino acid
MERKLMSLLPSISLSEMEPNSTLGNHNSNRSCTTENFKREFYPIVYLVIFIWGALGNGFSIYVFLKPYKKSTSVNVFMLNLAISDLLFTITLPFRVDYYLRGSNXIFGDTPCRIMSYSMYVNMYSSIYFLTVLSVVRFLATVHPFRLLHTTSIKNAWILCGVIWIFIMASSTVLLKNGSEQKDNVTLCLELNSNKVTKLKTMNYVALVVGFVLPFGTLSICYLLII

SEQ ID NO: 599 - protein, 176 aa, Solanum tuberosum
PGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSL

SEQ ID NO: 600 - protein, 276 aa, Sus scrofa
MWPLVVVVLLGSAYCGSAQLIFNITKSVEFTVCNTTVTIPCFVNNMEAKNISELYVKWKFKGKDIFIFDGAQHISKPSEAFPSSKISPSELLHGIASLKMDKRDAVIGNYTCEVTELSREGETIIELKRRFVSWFSPNENILIVIFPILAILLFWGQFGILTLKYKSSYTKEKTIFLLVAGLMLTIIVIVGAILFIPGEYSTKNACGLGLIVIPTAILILLQYCVFMMALGMSSFTIAILILQVLGHVLSVVGLSLCVSECTPVHGPLLISGLGII

SEQ ID NO: 601 - protein, 201 aa, Sus scrofa
EFYNQTWLHRYGESISPATLTTLWSLSVAIFSVGGMIGSFSVGLFVNRFGRRNSMLMMNLLAFISAVLMGFSKLGKSFEMLILGRFIIGVYCGLTTGFVPMYVGEVSPTALRGALGTLHQLGIVVGILIAQVFGLDSIMGNEELWPLLLSVIFIPALLQCVLLPFCPESPRFLLINRNEENRAKSVLKKLRGTADVTRDLQ

SEQ ID NO: 602 - protein, 176 aa, Sus scrofa
FGEVLCRVVNTMIYMNLYSSICFLMLVSIDRYLALVKTMSMGRMRGVRWAKLYSLVIWGCTLLLSSPMLAFRTMHEYAAEGHNVTACIIKYPSRSWMVFTNILLNSVGFLLPLSIITYCTVQILQVLRNNEMQKFKEIQTERKATVLVLAVLLLFVVCWLPFQISTFLDTLLRLGV

SEQ ID NO: 603 - protein, 126 aa, Malus domestica
MLACNCIEPQWPADELLMKYQYISDFFIALAYFSIPLELIYFVKKSAVFPYRWVLVQFGAFIVLCGATHLINLWTFSIHSRTVAMVMTTAKVLTAVVSCATALMLVHIIPDLLSVKTRELFLKNKA

SEQ ID NO: 604 - protein, 101 aa, Sus scrofa
NILLNSVGFLLPLSIITYCTVQILQVLRNNEMQKFKEIQTERKATVLVLAVLLLFVVCWLPFQISTFLDTLLRLGVLSGCWDEHAVDVITQISSYVAYSNS

SEQ ID NO: 605 - protein, 76 aa, Sus scrofa
TAVGPKHTASSELTTAESVTMSQHALGDVAGRGVTEKPQSVGALYIVLPIALLILLFFGTFLLWKNWRLKSINSIN

SEQ ID NO: 606 - protein, 101 aa, Meleagris gallopavo
LSLIALTAAMIILCLFRKLHCTRNYIHMHLFMSFIMRAIAVFIKDVTLFESGEPEHCFVSSVGCKAMMVFFQYCVMANFFWLLVEGLYLHTLLVISFFSER

SEQ ID NO: 607 - protein, 101 aa, Solanum tuberosum
MNYFPWLTIIVVFPIFAGSLIFFLPHKGNRVIRWYTICICILELLLTTYAFCYHFQSDDPLIQLVEDYKWIDFFDFHWRLGIDGLSIGPILLTGFITTLAT

SEQ ID NO: 608 - protein, 151 aa, Sus scrofa
YFFVLDSTNIELSKTGAGNLTRCFEHYEKGSMPVLIIHIFLVFSFFLVFLVILFCNLVIIRTLLTQSVQMQRNAEVKRRALWMVCTVLAVFIICFVPHHIVQLPWTLAELGFQSGNFHQAINDAHQITLCLLSTNCVLDPIIYCFLTKKFR

SEQ ID NO: 609 - protein, 176 aa, Sus scrofa
VSPLSLLACVFPSVFVNDGSKLPQKFYWWFFQTIPGMTGVLLLVVLAIMYVFASPYFRRRSFRGFWLTHHFYILLYVLLIIHGSFALIQLPRFHIFFLVPALIYVGDKLVSLSRKKVEISVVKAELLPSGVTHLQFQRPQGFEYKSGQWVRIACLGLGTNEYHPFTLTSAPHEDTL

SEQ ID NO: 610 - protein, 76 aa, Sus scrofa
DTFNPCEDIMGHDILRVLIWFISILAITGNIIVLVILITSQYKLTVPRFLMCNLAFADLCIGIYLLLIASVDIHTK

SEQ ID NO: 611 - protein, 126 aa, Solanum tuberosum
SQPQYIDLVKGVEGVTGIIMVILMAIAFTLATRWFRRSLIKFPKPFDRLTGFNAFWYSHHLLIIVYIVLIIHGTFLYLVHNWYSKTTWMYLAVPVLLYAGERTLRFFRSGLYTVRLLKVAIYPGNV

SEQ ID NO: 612 - protein, 126 aa, Sus scrofa
IYTDALQTLIMLIGALTLMGYSFAAVGGMEGLKEKYFLALASNRSGNSSCGLPREDAFHIFRDPLTSDLPWPGILFGMSIPSLWYWCTDQVIVQRTLAAKNLSHAKGGSLMAAYLKVLPLFIMVFP

SEQ ID NO: 613 - protein, 226 aa, Sus scrofa
NLSHAKGGSLMAAYLKVLPLFIMVFPGMVSRVLFPDQVACADPEICQKVCSNPAGCSDIAYPKLVLELLPMGLRGLMMAVMVAALMSSLTSIFNSASTIFTMDLWNHLRPRASERELMIVGRVFVLLLVLVSILWIPVVQASQGGQLFIYIQSISSYLQPPVAVVFIMGCFWKRTNEKGAFSGLILGLLLGLVRLVLDFIYPQPRCDQPDERPAVVRDVHYLYFSM

SEQ ID NO: 614 - protein, 101 aa, Sus scrofa
HETGSNNPTGISSDMDKIPFHPYYTIKDILGALFMMLILLILVLFSPDLLGDPDNYTPANPLNTPPHIKPEWYFLFAYAILRSIPNKLGGVLALVASILIL

SEQ ID NO: 615 - protein, 126 aa, Sus scrofa
DTFFDHFNRVQWAFSICEINGMILVGLWLIQWLLLKYKSIISRRFFCIVGTLYLYRCITMYVTTLPVPGMHFNCSPKLFGDWEAQLRRIMKLIAGGGLSITGSHNMCGDYLYSGHTVMLTLTYLFI

SEQ ID NO: 616 - protein, 151 aa, Sus scrofa
DKRDAVIGNYTCEVTELSREGETIIELKRRFVSWFSPNENILIVIFPILAILLFWGQFGILTLKYKSSYTKEKTIFLLVAGLMLTIIVIVGAILFIPGEYSTKNACGLGLIVIPTAILILLQYCVFMMALGMSSFTIAILILQVLGHVLSV

SEQ ID NO: 617 - protein, 126 aa, Sus scrofa
ISADIFSGAIFITLALGLDLYLAIFLLLAITGLYTITGGLAAVIYTDTLQTAIMLVGSFILTGFAFHEVGGYDAFIEKYMNAIPTVISDGNITIKKECYAPRADSFHIFRDPLKGDLPWPGLTFGL

SEQ ID NO: 618 - protein, 126 aa, Sus scrofa
TEFAVRSGLLTVMVWVSSVFFFLPVFCLTVLYSLIGRKLWRRKRGEAAVGSSLRDQNHKQTVKMLAVVVFAFILCWLPFHVGRYLFSKSLEPGSVEIAQISQYCNLVSFVLFYLSAAINPILYNIM

SEQ ID NO: 619 - protein, 276 aa, Sus scrofa
TSLLGSMFPLPRILFAMARDGLLFRFLARVSKRQSPVAATLTAGVISAVMAFLFDLKALVDMMSIGTLLAYSLVAACVLILRYQPGLSYEQPKYCPEKEALGSCASAASKSKSQVTVLPEWGFSLRAFFSPSLLPTKQSASLVSFLVGFLAFLILGLSILTTYGVHAIARLEAWSLALLVLFLVLCVAVVLTIWRQPQNQQKVAFMVPFLPFLPAFSILVNIYLMVQLSADTWIRFSIWMALGFLIYFAYGIRHSLEGNSRDEDEDEDTHSNNVHT

SEQ ID NO: 620 - protein, 76 aa, Sus scrofa
MATLWRLSVLCGARGGGALVLRTSVVRPAHVSAFLQDRHTPGWCGVQHIHLSPSHQASSKAASLHWTGERVVSVLL

SEQ ID NO: 621 - protein, 101 aa, Sus scrofa
VEMVDLIQNQEAKSSCVSLLSPSPGGDMRFSFLLRGYVVPMPTAGILSCTVALRPRTWSLDVHKTASTRLNIVSPGLPDKGLVLPAVLGITFGAFLIGALL

SEQ ID NO: 622 - protein, 76 aa, Sus scrofa
PMTLLHWAASPVLLPPEAPELLQLVRHIVLCLLLFDTEFFIWHVLHHKVPWLYRTFHKMHHQNSSSFALATQYMSV

SEQ ID NO: 623 - protein, 176 aa, Sus scrofa
FEWNALLLLLVLGWFFVPIYIKAGVMTMPEYLRKRFGGKRLQIYLSILSLFICVALRISSDIFSGAIFIKLALGLDLYLAIFSLLAITAIYTITGGLASVIYTDTLQTIIMLIGSFILMGFAFVEVGGYESFTEKYMNAIPTIVEGDNLTISPKCYTPQGDSFHIFRDAVTGDIPW

SEQ ID NO: 624 - protein, 76 aa, Meleagris gallopavo
LHESGSNNPLGISSNADKIPFHPYYSIKDILGLTIMLTPLLTLTLFSPNLLGDPENFTPANPLVTPPHIKPEWYFL

SEQ ID NO: 625 - protein, 176 aa, Sus scrofa
PKLETLDLAGNQLKALSNGSLPSGTQLRRLDLSGNSIGFVNPGFFALAKQLEELNLSANALKTVEPSWFGSMVGNLKVLDVSANPLHCACGATFVGFLLEVQAAVPGLPSRVKCGSPGQLQGHSIFAQDLRLCLDETLSWNCFGISLLAMALGLVVPMLHHLCGWDLWYCFHLCLA

SEQ ID NO: 626 - protein, 76 aa, Sus scrofa
MLSALGGLQRCFWAILLLALTVSLLAGFLHKDVRLLMPLLKGQAEGPPITNVMFLKTHKTASSTVLNILFRFAETH

SEQ ID NO: 627 - protein, 76 aa, Sus scrofa
VTERLSPSFLDLFRTQNLRKYTFILMYLWFTSSVLYQGLIMHVGATGGSLYLDFLYSALVEFPAAFVILLIIDRFG

SEQ ID NO: 628 - protein, 101 aa, Sus scrofa
FGDVKEKYLSEYCFSGTYILTLLLSGYHFTAETWKNIHFMGKVQSTSVGWTLGYMLNLTNMIPSEEPSSTRLSHSTYVFLMVLFSLILVIVVIIGLFVCHR

SEQ ID NO: 629 - protein, 76 aa, Salmo salar
MAHPSQLGFQDAASPVMEELLHFHDHALMIVLLISTLVLYIIVAMVSTKLTNKYILDSQEIEIVWTVLPAVILILI

SEQ ID NO: 630 - protein, 201 aa, Solanum tuberosum
MNYFPWLTIIVVFPIFAGSLIFFLPHKGNRVIRWYTICICILELLLTTYAFCYHFQSDDPLIQLVEDYKWIDFFDFHWRLGIDGLSIGPILLTGFITTLATLAAWPVTRDSRLFHFLMLAMYSGQIGSFSSRDLLLFFIMWELELIPVYLLLAMWGGKKRLYSATKFILYTAGGSVFLLMGVLGVALYGSNEPTLNFETSV

SEQ ID NO: 631 - protein, 176 aa, Sus scrofa
VMTIFLVVLYKYRCYKFIHGWLITSSLMLLFLFTYIYLGEVLKTYNVAMDYPTLFLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEED

SEQ ID NO: 632 - protein, 201 aa, Sus scrofa
MTGDTDPPKQSRTQYGSISSSPSPGPPQVPPGGTYLSEKIPIPNAEPGTFSLRKLWAFTGPGFLMSIAYLDPGNIQSDLQAGAVAGFKLLWVLLWATVLGLLCQRLAARLGVVTGKDLGEICHLYYPKVPRTLLWLNMELAIVGSDMQEVIGTAIAFNLLSAGRIPLWGGVLITVVDTFFFLYLNNYGLRKLEAFFAFLIA

SEQ ID NO: 633 - protein, 226 aa, Solanum tuberosum
MKTLYSLRRFYHVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVS

SEQ ID NO: 634 - protein, 76 aa, Sus scrofa
SAAKLNYTLLMYLKITSGGAVFHSPLMSVQPINVVKPDPPLGLHMEITDTGNLKISWSSPTLVPFQLQYQVKYSEN

SEQ ID NO: 635 - protein, 76 aa, Sus scrofa
LLRTYIISILFKSVFEVAFLLIQWYIYGFSLSAVYTCKRDPCPHQVDCFLSRPTEKTIFIIFMLVVSLVSLALNII

SEQ ID NO: 636 - protein, 276 aa, Solanum tuberosum
MIWHVQNENFILDSTRIFMKAFHLLLFDGSLIFPECILIFGLILLLMIDSTSDQKDIPWLYFISSTSLVLSITALLFRWREEPMISFSGNFQTNNFNEIFQFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAA

SEQ ID NO: 637 - protein, 276 aa, Solanum tuberosum; identical to SEQ ID NO: 636

SEQ ID NO: 638 - protein, 251 aa, Sus scrofa
FLMCNLAFADFCMGMYLLLIASVDLYTQSEYYNHAIDWQTGPGCNTAGFFTVFASELSVYTLTVITLERWYAITFAMRLDRKIRLRHAYAIMAGGWVCCFLLALLPLVGISSYAKVSICLPMDTETPLALAYIILVLLLNIVAFTIVCSCYVKIYITVRNPQYNPGDKDTKIAKRMAVLIFTDFMCMAPISFYALSALMNKPLITVTNSKILLVLFYPLNSCANPFLYAIFTKAFQRDVFILLSKFGFCKR

SEQ ID NO: 639 - protein, 76 aa, Sus scrofa
MSGHNNSELFVLCSSSQLFLQPLWDHLKTWETLILSPFFPVFFSITTYLGFCLPFVVLDVLCPWVPALRRYKIHPD

SEQ ID NO: 640 - protein, 251 aa, Sus scrofa
MLTVDDILEHTGEFNFFQKQTFFLLALLSAAFTPIYVGIVFLGFIPDHRCRSPGVAELSQRCGWSLAEELNYTVPGPGPAGQAFPRQCRRYEVDWNQSTLGCVDPLAGLAANSSHLPLGPCRYGWVYDTPGSSIVTEFDLVCANSWLLDLFQSAVNVGFFIGSVGIGYIADRFGRKLCLLLTILINAVSGVLMAISPTYTWMLVFRLIQGLVSKAGWMIGYILITEFVGLSYRRTVGIFYQVAFTFGLLVL

SEQ ID NO: 641 - protein, 76 aa, Meleagris gallopavo
CKLASAGISFNLYASVFLLTCLSIDRYLAIVHPVKSRIRRTMFVARVTCIVIWLLAGVASLPVIIHRNIFFAENLN

SEQ ID NO: 642 - protein, 176 aa, Sus scrofa
SVLLDQWMFGKVMCHIMPFLQCVTVLVSTLILISIAIVRYHMIKHPVSNNLTANHGYFLIATVWTLGLAICSPLPVFHSLVELQESFGSAWLSSRYLCVESWPSDSYRIAFTISLLLVQYILPLVCLTVSHTSVCRTISCGLSSQDSKLEENEMINLTLQPAKRSGPQAKLSHHPK

SEQ ID NO: 643 - protein, 76 aa, Sus scrofa
MKTPLLALALWSLLLQLGLTFWPSSVSQNCHNGSYEISVLMMNNSAFPESLDNLKAVVNEGVNIVRQRLLEAGLTV

SEQ ID NO: 644 - protein, 276 aa, Sus scrofa
MAWNTNLRWRLPLTCLLLQVIMVILFGVFVRYDPDADAHWIDERLGRNISSDMDNEFYYRYPSFQDVHVMIFVGFGFLMTFLQRYGFSSVGFNFLLAAFGIQWALLMQGWLHSFHSGYIVLGVENLINADFCVGSVCVAFGAVLGKVSPVQLLIMTLFQVTLFSVNEFILLNLLEVKDAGGSMTIHTFGAYFGLTVTWILYRPNLYQSKERQSSVYHSDLFAMIGTLFLWMYWPSFNSAVSHHGDAQHRAAINTYCSLAACVLTSVALSSALHKKG

SEQ ID NO: 645 - protein, 101 aa, Sus scrofa
TECSEETPTTTSHSQAFNFWDLIRLLCSVQYGSVLFVAWFMGFGYGFVFTFLYWHLEDLNGTTTLFGVCSVLSHVSELTAYFFSHKLIELIGHIRVLYIGL

SEQ ID NO: 646 - protein, 251 aa, Sus scrofa
ISADIFSGAIFITLALGLDLYLAIFLLLAITGLYTITGGLAAVIYTDTLQTAIMLVGSFILTGFAFHEVGGYDAFIEKYMNAIPTVISDGNITIKKECYAPRADSFHIFRDPLKGDLPWPGLTFGLSILALWYWCTDQVIVQRCLSAKNMSHVKAGCVMCGYFKLLPMFVIVMPGMISRVLYTEKIACTVPSECEKYCGTKVGCSNIAYPTLVVELMPNGLRGLMLSVILASLMSSLTSIFNSATTLFTMD

SEQ ID NO: 647 - protein, 176 aa, Sus scrofa
MASPSRPGNDCSHVIDHSHVPEFEVATWIKITLILLFLVIFVVGILGNSVTIRVTQVLQKKGYLQKEVTDHMVSLACSDILVFLIGMPVEFYSIIWNPLTTPSYTVSCKLHSFLFETCSYATLLHVLTLSFERYIAICHPFRYKAMSGPCQVKLLIGFVWVTSTLVALPLLFAMGV

SEQ ID NO: 648 - protein, 276 aa, Sus scrofa
FVGLGYRKTVAILYQTAFSVGLVLLSGLAYAVPHWRSLQLAVSLPIFLLLLCYWFVPESPRWLLSQKRNTQAIKIMDRIAQKNGKLPPADLKMLSLEEEVVTERLSPSFLDLFRTQNLRKYTFILMYLWFTSSVLYQGLIMHVGATGGSLYLDFLYSALVEFPAAFVILLIIDRFGRLYLLAGSNLLAGAACFFMIFISHDLHWLSIVAACIGRMGITIVFQMVCLVSAELYPTFIRNLGVMVCSSLCDLGGVVAPFLVFRLTEVWRGLPLVLFAA

SEQ ID NO: 649 - protein, 251 aa, Solanum tuberosum
GQLSIIFLWLSGMYFHGARFSNYEAWLSDPTHIGPSAQVVWPIVGQEILNGDVGGGFRGIQITSGFFQLWRASGITSELQLYCTAIGALVFAALMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYADFLTFRGGLDPVTGGLWLTDIAHHHLAIAILFLIAGHMYRTNWGIGHGLKDILEAH

SEQ ID NO: 650 - protein, 226 aa, Meleagris gallopavo
MSMANFTAGRNSCTFQEEFKQVLLPLVYSVVFLLGLPLNAVVIGQIWLARKALTRTTIYMLNLATADLLYVCSLPLLIYNYTQKDYWPFGDFTCKFVRFQFYTNLHGSILFLTCISVQRYMGICHPLASWHKKKGKKLTWLVCAAVWFIVIAQCLPTFVFASTGTQRNRTVCYDLSPPDRSASYFPYGITLTITGFLLPFAAILACYCSMARILCQKDELIGLAVH

SEQ ID NO: 651 - protein, 76 aa, Sus scrofa
TMNYVALVVGFVLPFGTLSICYLLIIRALLKVEVPESGLRLSHRKALITVIIALIIFLLCFLPYHVLRTLHLLEWK

SEQ ID NO: 652 - protein, 76 aa, Sus scrofa
AEYANIIMMNAFTAILFLGASHDPHTPELYTINFVLKTLALTITFLWIRASYPRFRYDQLMHLLWKSFLPLTLALC

SEQ ID NO: 653 - protein, 276 aa, Sus scrofa
RFHEDFKYVLLPLSYGVVCVLGLSLNAGALYIFLCRLKTWNASTTYMFHLAVSDALYAASLPLLVYYYARGDHWPFSTALCKLVRFLFYTNLYCSILFLTCISVHRCLGVLRPLRSLRWGHARYARRVAAAVWGLVLACQAPALYFITTTAQGGRITCHDTSAPELFSHFVAYSLVMLSVLFAAPFAVILVCYALMARRLLRPAYGTAGGLPRAKRKSVRTIAVVLAVFALCFLPFHVTRTLYYSFRTLDLSCHTLDAINMAYKITRPLASANSCL

SEQ ID NO: 654 - protein, 76 aa, Sus scrofa
IIDLIVVVASMVVLCVGSKGQVFATSAIRGIRFLQILRMLHVDRQGGTWRLLGSVVFIHRQELITTLYIGFLGLIF

SEQ ID NO: 655 - protein, 126 aa, Sus scrofa
ITFRFYGPDLLCRLVKYLQVVGMFASTYLLLLMSLDRCLAICQPLRALRRPADRLAVLATWLGCLVASAPQVHIFSLREVADGVFDCWAVFIQPWGPKAYITWITLAVYIVPVIVLAACYGLISFK

SEQ ID NO: 656 - protein, 201 aa, Sus scrofa
MASQTLVVFQASNQSQLPPPNATLCDGAQEAWHLLHKVLPTCVVAICSGGLLGNLFVLSVFLVPRRRLNAAEIYLAHLAASDLVFALGLPFWAETIRNGFHWPFGAPLCRVVNGVIKANLFISIFLVVAISRDRYRALVHPVASWRRRRRRHWAQATCVLIWTAGGLLSIPTFLLRSVQVVPELNVSACVLPFPHEAWAFV

SEQ ID NO: 657 - protein, 76 aa, Sus scrofa
VLGVLGLTWFINKFRIVKLTPKDQFIIAYGGLRGAIAFSLGHLLDKNHFPMCDLFLTAIITVIFFTVFVQGMTIRP

SEQ ID NO: 658 - protein, 176 aa, Sus scrofa
MAWNTNLRWRLPLTCLLLQVIMVILFGVFVRYDPDADAHWIDERLGRNISSDMDNEFYYRYPSFQDVHVMIFVGFGFLMTFLQRYGFSSVGFNFLLAAFGIQWALLMQGWLHSFHSGYIVLGVENLINADFCVGSVCVAFGAVLGKVSPVQLLIMTLFQVTLFSVNEFILLNLLEV

SEQ ID NO: 659 - protein, 76 aa, Sus scrofa
RFHEDFKYVLLPLSYGVVCVLGLSLNAGALYIFLCRLKTWNASTTYMFHLAVSDALYAASLPLLVYYYARGDHWPF

SEQ ID NO: 660 - protein, 176 aa, Sus scrofa
LIIFEIVHRTLAAMLGSLAALAALAVIGDRPTLTQVVEWIDFETLALLFGMMILVAIFSETGFFDYCAVKAYQLSRGRVWAMIIMLCLIAAVLSAFLDNVTTALLFTPVTIRLCEVLNLDPRQVLIAEVIFTNIGGAATAIGDPPNVIIVSNQELRKMGLDFAGFTAHMFAGICFV

SEQ ID NO: 661 - protein, 226 aa, Sus scrofa
MNTSCDPMNQPVNSTCPGLMCVFQGYLSTGLVQRSLFNLQIYGVLGLFWTINWVLALGQCVLAGAFASFYWAFHKPRDIPTFPLSSAFIRTLRYHTGSLAFGALILTLVQIARAILEYIDHKLRGAQNPVARCIMCCFKCCLWCLEKFIKFLNRNAYIMIAIYGKNFCVSAKNAFMLLMRNIVRVVVLDKVTDLLLFFGKLLVVGGVGVLSFFFFTGRIQGLGKDF

SEQ ID NO: 662 - protein, 151 aa, Sus scrofa
FVAPNTLFANGSVYPPNEGFCPCMESGIQNVSTCRFNAPLFLSHPHFYNADPVLAEAVSGLHPNTEEHSLFLDIHPVTGIPMNCSVKLQLSLYIKSVKGIGQTGKIEPVVLPLLWFAESGAMEGETLQTFYTQLVLMPKVLHYAQYVLLAL

SEQ ID NO: 663 - protein, 126 aa, Sus scrofa
LAPPVTAVFVLGIFWRRANEQGAFWGLMVGLAVGAWRLVLEFLHPAPPCGHPDVRPALLRTVHYLHFAVALFVLSGAVVAAVSLLTPPPAGVQIENLTWWTLARDRPSGAKTGDGPASQKHAFWAR

SEQ ID NO: 664 - protein, 126 aa, Solanum tuberosum
MKTLYSLRRFYHVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLG

SEQ ID NO: 665 - protein, 76 aa, Salmo salar
ISGLLIALELASLTNKQFKTTPNLITHNFSNMLGFFPAIIHRLAPKLNLTLGQTIASQMVDQTWFEKIGPKGVVST

SEQ ID NO: 666 - protein, 126 aa, Solanum tuberosum
PKFMGIELVTLKKIIPLGAMFFCILFNYTILRDTKDVLVVTAKGSSAEIIPFLKTWVNLPMAIGFMLLYTKLANVLSKEALFYTVILPFIAFFGAFGFVLYPLSNYFHPTAFADKLLNTLGPRFLG

SEQ ID NO: 667 - protein, 276 aa, Sus scrofa
MESLFPAPFWEVLYGSPLQGNLSLLSPNHSLLPPHLLLNASHGAFLPLGLKVTIVGLYLAVCVGGLLGNCLVMYVILRHTKMKTATNIYIFNLALADTAVLLTLPFQGTDVLLGFWPFGNALCKAVIAIDYYNMFTSAFTLTAMSVDRYVAICHPIRALDVRTSSKAQAVNVAIWALASIVGVPVAIMGSAQVEDEEIECLVEIPAPQDYWGPVFAVCIFLFSFVIPVLIISVCYSLMVRRLRGVRLLSGSREKDRNLRRITRLVLVVVAVFVGCW

SEQ ID NO: 668 - protein, 276 aa, Sus scrofa
MHMFRDPATGDLPWTGMTFGLTIMATWYWCTDQVIVQRSLSARDLNHAKGGSILASYLKMLPMGLMVMPGMISRVLFPDDVGCVVPSECLRACGAEIGCSNIAYPKLVMELMPTGLRGLMVAVMMAALMSSLTSIFNSSSTLFTMDVWRRLRPRAGERELLLVGRLVIVVLIGVSVAWIPVLQGSNSGQLFIYMQSVTSSLAPPVTAVFVLGIFWRRANEQGAFWGLMVGLAVGAWRLVLEFLHPAPPCGHPDVRPALLRTVHYLHFAVALFVLSG

SEQ ID NO: 669 - protein, 201 aa, Sus scrofa
IISADEGAFAYIVNYFMYVLWALLFAFLAVSLVKVFAPYACGSGIPEIKTILSGFIIRGYLGKWTLIIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLG

SEQ ID NO: 670 - protein, 151 aa, Sus scrofa
IRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGHLLDKNHFPM

SEQ ID NO: 671 - protein, 176 aa, Sus scrofa
CLLDFQRALALFVLFCVVLFFLAHSLLKRLLGPKLLRCVKPLRHPCLNLWFKRGLALAAFLGLVLWLVLDTAQRPEQLVSFGGICVFILLLFAGSKHHRAVSWRAVSWGLGLQFALGLFVIRTEPGFIAFQWLGDQIQIFLSYTEAGSSFVFGEALVKDVFAFQVLPIIVFFSCAM

SEQ ID NO: 672 - protein, 176 aa, Sus scrofa
RFHEDFKYVLLPLSYGVVCVLGLSLNAGALYIFLCRLKTWNASTTYMFHLAVSDALYAASLPLLVYYYARGDHWPFSTALCKLVRFLFYTNLYCSILFLTCISVHRCLGVLRPLRSLRWGHARYARRVAAAVWGLVLACQAPALYFITTTAQGGRITCHDTSAPELFSHFVAYSLV

SEQ ID NO: 673 - protein, 176 aa, Sus scrofa
DAAVDFHRLIASTAIILTVLHSAGHVVNVYLFSISPLSVLSCLFPGLFHDNGSEFPQKYYWWFFQTVPGLTGVMLLLILAIMYVFASHHFRRCSFRGFWLTHHLYILLYMLLIIHGSFALIQLPRFHIFFLVPALIYVGDKLVSLSRKKVEISVVKAELLPSGVTHLQFQRPQGFE

SEQ ID NO: 674 - protein, 276 aa, Solanum tuberosum
RGGLDPVTGGLWLTDIAHHHLAIAILFLIAGHMYRTNWGIGHGLKDILEAHKGPFTGQGHKGLYEILTTSWHAQLSLNLAMLGSLTIVVAHHMYSMPPYPYLATDYGTQLSLFTHHMWIGGFLIVGAAAHAAIFMVRDYDPTTRYNDLLDRVLRHRDAIISHLNWACIFLGFHSFGLYIHNDTMSALGRPQDMFSDTAIQLQPVFAQWIQNTHALAPGATAPGATASTSLTWGGGDLVAVGGKVALLPIPLGTADFLVHHIHAFTIHVTVLILLKG

SEQ ID NO: 675 - protein, 101 aa, Salmo salar
HETGSNNPAGINSDADKISFHPYFSYKDLLGFVAMLLGLTSLALFAPNLLGDPDNFTPANPLVTPPHIKPEWYFLFAYAILRSIPNKLGGVLALLFSILVL

SEQ ID NO: 676 - protein, 226 aa, Sus scrofa
GCVDPLAGLAANSSHLPLGPCRYGWVYDTPGSSIVTEFDLVCANSWLLDLFQSAVNVGFFIGSVGIGYIADRFGRKLCLLLTILINAVSGVLMAISPTYTWMLVFRLIQGLVSKAGWMIGYILITEFVGLSYRRTVGIFYQVAFTFGLLVLAGVAYALPHWRWLQFTVTLPNFCFLFYYWCVPESPRWLISQNKNAKAMSIIKHIAKKNGKSLPASLQSLRPDEEV

SEQ ID NO: 677 - protein, 101 aa, Sus scrofa
MRTLNTSTMDGTGLVVERDFSFRILTACFLSLLILSTLLGNTLVCAAVIRFRHLRSKVTNFFVISLAVSDLLVAVLVMPWKAVAEIAGFWPFGSFCNIWVA

SEQ ID NO: 678 - protein, 101 aa, Sus scrofa
TMDLWNHLRPRASERELMIVGRVFVLLLVLVSILWIPVVQASQGGQLFIYIQSISSYLQPPVAVVFIMGCFWKRTNEKGAFSGLILGLLLGLVRLVLDFIY

SEQ ID NO: 679 - protein, 176 aa, Sus scrofa
WPGMIFGMTVVAAWYWCTDQVIVQRCLSGKDMSHVKAACIMCGYLKLLPMFLMVMPGMISRILYTEKVACVVPSECVKHCGTEVGCSNYAYPLLVMELMPSGLRGLMLSVMLASLMSSLTSIFNSASTLFTMDLYTKIRKQASEKELLIAGRLFIILLIVISIVWVPLVQVAQNGQ

SEQ ID NO: 680 - protein, 126 aa, Salmo salar
TVNYLGIQFDVKFWSQHISFILVGIIIVTSIRGLLITLTKFFYAISSSKSSNVIVLVLAQIMGMYFVSSVLLMRMSMPLEYRSIVTEVLGELQFNFYHRWFDVIFLVSALSSILFLYLAHKQAPEK

SEQ ID NO: 681 - protein, 76 aa, Sus scrofa
NTLCLPFTLTYTLMGEWKMGPVLCHLVPYAQGLAVQVSTITLTVIALDRHRCIVYHLESKISKRISFLIIGLAWGI

SEQ ID NO: 682 - protein, 226 aa, Solanum tuberosum
MIIDTTEIETINSFSKLESLKEVYGIIWMLVPIVTLVLGITIGVLVIVWLEREISAGIQQRIGPEYAGPLGILQALADGTKLLLKENLIPSTGDTRLFSIGPSIAVISIFLSYSVIPFGDHLVLADLSIGVFFWIAISSIAPVGLLMSGYGSNNKYSFLGGLRAAAQSISYEIPLALCVLSISLLSNSSSTVDIVEAQSKYGFWGWNLWRQPIGFIVFLISSLAEC

SEQ ID NO: 683 - protein, 201 aa, Sus scrofa
SGLRGLMLSVMLASLMSSLTSIFNSASTLFTMDLYTKIRKQASEKELLIAGRLFIILLIVISIVWVPLVQVAQNGQLFHYIESISSYLGPPIAAVFLLAIFCKRVNEQGAFWGLIIGFVMGLIRMIAEFVYGTGSCLAASNCPQIICGVHYLYFALILFFVSILVVLAISLLTKPIPDVHLYRLCWALRNSTEERIDLDAE

SEQ ID NO: 684 - protein, 126 aa, Sus scrofa
FRDISKWNNRVVSNLLYYQTNYLVVAAMMISVVGFLSPFNMILGGIVVVLVFTGFVWAAHNKDILRRLKKQYPTVFVMVVMLASYFLISMFGGVMVFVFGITFPLLLMFIHASLRLRNLKNKLENK

SEQ ID NO: 685 - protein, 126 aa, Sus scrofa
MNSTLSSQVENHSIYYNFSEKNSQFLAFENDDCHLPLAMIFTLALAYGAVIILGVSGNLALIIIILKQKEMRNVTNILIVNLSFSDLLVAIMCLPFTFVYTLMDHWVFGEVMCKLNPFVQCVSITV

SEQ ID NO: 686 - protein, 76 aa, Capra hircus
IAILLLTGFLLLVWNYEDTSSIPGPSYFLGIGPLISHCRFLWMGIGSACNYYNKMYGEFMRVWVCGEETLIISKSS

SEQ ID NO: 687 - protein, 176 aa, Sus scrofa
TSLLGSMFPLPRILFAMARDGLLFRFLARVSKRQSPVAATLTAGVISAVMAFLFDLKALVDMMSIGTLLAYSLVAACVLILRYQPGLSYEQPKYCPEKEALGSCASAASKSKSQVTVLPEWGFSLRAFFSPSLLPTKQSASLVSFLVGFLAFLILGLSILTTYGVHAIARLEAWSL

SEQ ID NO: 688 - protein, 76 aa, Capra hircus
MAYPMQLGFQDATSPIMEELLHFHDHTLMIVFLISSLVLYIISLMLTTKLTHTSTMDAQEVETVWTILPAIILIMI

SEQ ID NO: 689 - protein, 76 aa, Sus scrofa
GQTGKIEPVVLPLLWFAESGAMEGETLQTFYTQLVLMPKVLHYAQYVLLALGCVLLFIPIVYQIRSQEKCYLFWSS

SEQ ID NO: 690 - protein, 201 aa, Sus scrofa
MAPALLLVPAALASFILAFGTGVEFVRFTSLRPLLGGIPESGGPDARQGWLAALQDQSILVPLAWDLGLLLLFVGQHSLMATETVKAWMSRYFGVLQRSLYVACTALALQLVMRYWEPVPRGPVLWEAQAEPWATWVPLLCFVLHVISWLLIFSILLVFDYAELMGLKQVYYHVLGLGEPLALKSPRALRLFSHLRHPVCV

SEQ ID NO: 691 - protein, 251 aa, Sus scrofa
KVTKICDQDGNWFRHPESNRTWTNYTQCNINTHEKVQTALNLFYLTIIGHGLSIASLLISLGIFFYFKSLSCQRITLHKNLFFSFVCNSIVTIIHLTAVANNQALVATNPVSCKVFQFIHLYLMGCNYFWMLCEGIYLHTLIVVAVFAEKQHLMWYYFLGWGFPLIPACIHAVARRLYYNDNCWISSDTHLLYIIHGPICAALLVNLFFLLNIVRVLITKLKVTHQAESNLYMKAVRATLILVPLLGIEFV

SEQ ID NO: 692 - protein, 76 aa, Sus scrofa
MAYPFQLGFQDATSPIMEELLHFHDHTLMIVFLISSLVLYIISLMLTTKLTHTSTMDAQEVETIWTILPAIILILI

SEQ ID NO: 693 - protein, 226 aa, Solanum tuberosum
TIGLRTNEDLYTGALFLLFLSAISLIAGWLHLQPKWKPSVSWFKNAESRLNHHLSGLFGVSSLAWTGHLVHVAIPASRGEYVRWNNFLDVLPHPQGLGPLFTGQWNLYAQNPDSSSHLFGTAEGAGTAILTLLGGFHPQTQSLWLTDMAHHHLAIAFIFLVAGHMYRTNFGIGHSMKDLLDAHIPPGGRLGRGHKGLYDTINNSLHFQLGLALASLGVITSLVAQH

SEQ ID NO: 694 - protein, 76 aa, Sus scrofa
MDFLLLLLLLASSALAGLASWTVSRPETVQGIKGSCLIIPCTFGFPANVEVPHGITAIWYYDYSGKRLVVSHSRNP

SEQ ID NO: 695 - protein, 101 aa, Solanum tuberosum
QFLILLCSTLCIPLSVEYIECTEMAITEFLLFVLTATLGGMFLCGANDLITIFVAPECFSLCSYLLSGYTKKDVRSNEATMKYLLMGGASSSILVHGFSWL

SEQ ID NO: 696 - protein, 101 aa, Solanum tuberosum; identical to SEQ ID NO: 695

SEQ ID NO: 697 - protein, 226 aa, Sus scrofa
YRPQLEKSKHRQSSVYHSDLFAMIGTIFLWIFWPSFNSAPTPLGDGQHRTALNTYYSLTASTLSTFALSALVGRDGRLDMVHVQNAALAGGVVVGTSAEMMLTPFGALAAGFLAGTVSTLGFKFFTPILESKFKIQDTCGVHNLHGMPGVLGALLGVLVAGLATHDSYGEGLESVFPLIAEGQRSSTSQALHQLFGLFVTLIFASVGGGLGGLLLRLPFLDSPPDS

SEQ ID NO: 698 - protein, 276 aa, Salmo salar
MTLLTHVLACLFGMGSWVAINGIWVELPLIVPEIPEGWYLPSYLTVLIQMANVGPLFVTLMHRFRPGKLDERPVIYSIVGLGVVATFLLAFFWKHTVPLAGATHSVPLLVLCFLLSVVDCTSSVTFLPFMMRLGPQYLTTYFVGEGVSGLVPAVVALVQGVGVVHCRNATVASLANGTLGVNSTVGASGELQAQYQPANFSAQVFFLFLSAMMVVCLAAFLLLNHHPAVAREKKCEQYFNGGLAEEKSDQALSLSHRPQEEKPMISSPDSHRRARQ

SEQ ID NO: 699 - protein, 226 aa, Sus scrofa
MLLWSGICGLSPPRIFPSLLVVVALVGLLPVLRSHGLQPSPTASTIRGSEPPRERSIGDVTTAPPELAPESRPVNHSVTEHGMKARKAFPVLGIDYTHVRTPFEISLWILLACLMKIGFHVIPTISSIVPESCLLIVVGLLVGGLIKAVGETPPFLQSEVFFLFLLPPIILDAGYFLPLRQFTENLGTILIFAVVGTLWNAFFLGGLMYAVCLVGGEQINNIGLLD

SEQ ID NO: 700 - protein, 176 aa, Solanum tuberosum
MIFSTLEHILTHISFSIVSIVITIHLITFLVDEIVKLYDSSEKGIIVTFFCITGLLVTRWISSGHFPLSDLYESLIFLSWSFSLIHIIPYFKKNVLILSKITGPSAILTQGFATSGILTEIHQSGILVPALQSEWLIMHVSMMILGYAALLCGSLLSVALLVITFRKNRKLFYKSN

SEQ ID NO: 701 - protein, 76 aa, Sus scrofa
IYVLQLLARTMFEVGFLIGQYFLYGFQVHPFYVCSRVPCPHKIDCFISRPTEKTIFLLIMYGVTGLCLLLNIWEML

SEQ ID NO: 702 - protein, 201 aa, Solanum tuberosum
QFLILLCSTLCIPLSVEYIECTEMAITEFLLFVLTATLGGMFLCGANDLITIFVAPECFSLCSYLLSGYTKKDVRSNEATMKYLLMGGASSSILVHGFSWLYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEI

SEQ ID NO: 703 - protein, 201 aa, Solanum tuberosum; identical to SEQ ID NO: 702

SEQ ID NO: 704 - protein, 176 aa, Sus scrofa
NLQKEISLAKARHGIADLFRTPVLRRVTLCLSLAWFATGFAYYSLAMGVEEFGVNLYVLQLIFGGVDVPAKFITMLSISYLGRHITEGIVLLLAGGCILALIFVPLDLMTLRTVLAVFGKGCLSGSFSCLFLYTSELYPTVIRQTGMGASNLWARVGSMTAPLVKITGELQPFIPN

SEQ ID NO: 705 - protein, 176 aa, Sus scrofa
MGPRCTLHPLSLLVQVTALAAALAQGRLPAFLPCELQPHGLVNCNWLFLKSVPHFSAAAPRANVTSLSLLSNRIHHLHDSDFVHLSSLRTLNLKWNCPPAGLSPMHFPCHMTIEPNTFLAVPTLEELNLSYNSITTVPALPDSLVSLSLSRTNILVLDPTHLTGLHALRYLYMDGN

SEQ ID NO: 706 - protein, 76 aa, Solanum tuberosum
PGGEVIDTFPYFVSGVLHLISSAVLGFGGIYHALLGPETLEESFPFFGYVWKDRNKMTTILGIHLILLGIGAFLLV

SEQ ID NO: 707 - protein, 76 aa, Salmo salar
VLLRFLAGIMVWVMIVMVILVIGYGIFHCSMEYVSLKSEAGSNVTLKDLGFQTDFSVYLHIRQTWLAFIIILAIVE

SEQ ID NO: 708 - protein, 76 aa, Sus scrofa
FPIPLPFCWLCRTLIKRIQAVVPKGVLLKAVAQVCHVVPLPVGGICQCLAERYIVICLNMLLDRTLPQLVCGLVLR

SEQ ID NO: 709 - protein, 201 aa, Sus scrofa
AFFLGGLMYAVCLVGGEQINNIGLLDNLLFGSIISAVDPVAVLAVFEEIHINELLHILVFGESLLNDAVTVVLYHLFEEFANYDRVGIVDIVLGFLSFFVVSLGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVS

SEQ ID NO: 710 - protein, 226 aa, Meleagris gallopavo
MVPNYSTEETVKRIHVDCPVSGRHSYIYIMVPTVYSIIFIIGIFGNSLVVIVIYCYMKLKTVASIFLLNLALADLCFLITLPLWAAYTAMEYQWPFGNCLCKLASAGISFNLYASVFLLTCLSIDRYLAIVHPVKSRIRRTMFVARVTCIVIWLLAGVASLPVIIHRNIFFAENLNMTVCGFRYDNNNTTLRVGLGLSKNLLGFLIPFLIILTSYTLIWKTLKKAY

SEQ ID NO: 711 - protein, 276 aa, Sus scrofa
AIMAFTFGYEYVVARPAQGALLRGLFLPSCSGCGQPELLQAVGIVGAIIMPHNIYLHSALVKSREVDRTRREDIREANMYFLIESTIALFVSFFINLFVMAVFGQAFYQQTNQAAFNICANSSLHDYAKIFPRNNLTVAVDFYQGGVILGCLFGPAALYIWAVGLLAAGQSSTMTGTYAGQFVMEGFLKLRWSRFARLLLTRSCAILPALLVAVFKELQDLSSLNDLLNVLQSLLLPFAVLPILTFTSMPALMQEFASGRVNKVITSSIMLLVCAI

SEQ ID NO: 712 - protein, 126 aa, Sus scrofa
RRVAAAVWGLVLACQAPALYFITTTAQGGRITCHDTSAPELFSHFVAYSLVMLSVLFAAPFAVILVCYALMARRLLRPAYGTAGGLPRAKRKSVRTIAVVLAVFALCFLPFHVTRTLYYSFRTLDL

SEQ ID NO: 713 - protein, 101 aa, Sus scrofa
LSFADFCMGLYLLLIASVDAQTKGQYYNHAIDWQTGNGCSVAGFFTVFASELSVYTLTVITLERWHTITYAIQLDQKLRLRHAIPIMLGGWLFSTLIAMLP

SEQ ID NO: 714 - protein, 101 aa, Solanum tuberosum
HFFWNNHKHFFDYGSTTRNSMRNLSIQCVFLNNLIFQLFNHFILPSSMLARLVNIYLFRCNNKILFVTSGFVGWLIGHILFMKWLGLVLVWIRQNHSIRSN

SEQ ID NO: 715 - protein, 251 aa, Sus scrofa
MTFAELVDRVGSKGPFQLLHTVLLGLPILGMANHNLLQIFTAPTPAHHCRPPPNASAGPWVLPTGLNGKPETCLRFVYPPNASLPNDTRGATEPCLDGWIYNIVDRDSIVTEWDLVCSSSKLKEMAQSVFMAGILVGGLVLGALSDRFGRKPILIFSYLLLGASGSGAAFSPTFSIYAVFRFLCGFSISGISLSTAILNVEWVSTRFRAIKSIAVGFFYTFGQFILPGLAYAIPQWRWLQLTVSVPFLTFF

SEQ ID NO: 716 - protein, 226 aa, Sus scrofa
MGSEIPDYYNKTLASENNTVATRNSGFPVWEDYKGSVDDLQYFLIGLYTFVSLLGFMGNLLILMAVMRKRNQKTTVNFLIGNLAFSDILVVLFCSPFTLTSVLLDQWMFGKVMCHIMPFLQCVTVLVSTLILISIAIVRYHMIKHPVSNNLTANHGYFLIATVWTLGLAICSPLPVFHSLVELQESFGSAWLSSRYLCVESWPSDSYRIAFTISLLLVQYILPLVC

SEQ ID NO: 717 - protein, 76 aa, Salmo salar
MTLLTHVLACLFGMGSWVAINGIWVELPLIVPEIPEGWYLPSYLTVLIQMANVGPLFVTLMHRFRPGKLDERPVIY

SEQ ID NO: 718 - protein, 76 aa, Salmo salar
MANLRKTHPLLKIANDALVDLPAPSNISVWWNFGSLLGLCLATQILTGLFLAMHYTSDISTAFSSVCHICRDVSYG

SEQ ID NO: 719 - protein, 276 aa, Sus scrofa
MLNLTSQVPEPALNGTLPQSSSCFHSDWWNWLNTIQAPFLWVLFLLAALENIFVLSVFCLHKNSCTVAEIYLGNLAMADLILALGLPFWAITIANHFDWLFGEVLCRVVNTMIYMNLYSSICFLMLVSIDRYLALVKTMSMGRMRGVRWAKLYSLVIWGCTLLLSSPMLAFRTMHEYAAEGHNVTACIIKYPSRSWMVFTNILLNSVGFLLPLSIITYCTVQILQVLRNNEMQKFKEIQTERKATVLVLAVLLLFVVCWLPFQISTFLDTLLRLGV

SEQ ID NO: 720 - protein, 176 aa, Solanum tuberosum
TLAAWPVTRDSRLFHFLMLAMYSGQIGSFSSRDLLLFFIMWELELIPVYLLLAMWGGKKRLYSATKFILYTAGGSVFLLMGVLGVALYGSNEPTLNFETSVNQSYPVVLEIIFYIGFFIAFAVKSPIIPLHTWLPDTHGEAHYSTCMLLAGILLKMGAYGLIRINMELLPHAHSIF

SEQ ID NO: 721 - protein, 101 aa, Sus scrofa
TSAFKYINTVISCTIFIVGMVGNATLLRIIYQNKCMRNGPNALIASLALGDLIYVVIDLPINVFKLLAGRWPFENHDFGVFLCKLFPFLQKSSVGITVLNL

SEQ ID NO: 722 - protein, 126 aa, Sus scrofa
AAWFLQELPSFVVPAGILAGQPRSLFGPPATVLLGLFCAHYFHRTFVYSLLTRGRPFPVVFLFRGFVFCMGNGLLQGYYLVYCAEYPAEWYTDIRFSLGVFLFILGMGINIHSDYILRQLRKPGEV

SEQ ID NO: 723 - protein, 126 aa, Meleagris gallopavo
MSMANFTAGRNSCTFQEEFKQVLLPLVYSVVFLLGLPLNAVVIGQIWLARKALTRTTIYMLNLATADLLYVCSLPLLIYNYTQKDYWPFGDFTCKFVRFQFYTNLHGSILFLTCISVQRYMGICHP

SEQ ID NO: 724 - protein, 251 aa, Capra hircus
DYGENETYFCCTSPPCPQDFSLNFDRTFLPVLYSLLFVLGLLGNGVVAVVLLSQRAALSSTDTFLLHLAVADALLVLTLPLWAVDAAIQWVFGSGLCKVAGALFNINFYAGALLLACISFDRYLSIVHATQFYRRGPPARVALTCVAVWGLCLLFALPDFIFLSSHHDNRLNATHCQYNFPQEGRTALRVLQLVAGFLLPLLVMAYCYARILTVLLVSRGQRRLRAMRLVVVVVVAFALCWTPYHLVVLVD

SEQ ID NO: 725 - protein, 126 aa, Sus scrofa
PALDLCIAINPSILPTAFMGTAMIFTCFTLSALYARRRSYLFLGGILMSAMSLMVLSSLGNLFFGSIWLFQANLYVGLVVMCGFVLFDTQLIIEKAENGDKDYIWHCVDLFSDFVTLFRKLMMILA

SEQ ID NO: 726 - protein, 201 aa, Sus scrofa
MESPAGRTPAPGALPYYVAFSQLLGLTVVAVTGAWLGAYRGGIAWESALQFNVHPLCMIIGLVFLQGDALLVYRVFRNEAKRTTKILHGLLHVLAFVIALVGLVAVFDYHRKKGIADLYSLHSWCGILVFVLFLAQWLVGLGFFLFPGASFSLRSRYRPQHVFFGAAIFLLSVGTALLGLKEALLFQLGTKYSAFESEGVL

SEQ ID NO: 727 - protein, 201 aa, Sus scrofa
FLDLQLNATEGNVSGPSVGNTSSPCEDMGIEVEVFLTLGLISLLENILVIGAIARNKNLHVPMYFFVCSLAVADMLVSLSNSWETITIYLIANKHLVLSDTSVRHLDNVFDSMICISLVASMCSLLAVAVDRYVTIFYALRYQHLMTGRRCGAIIAGIWALCTGCGPVFIVYYESTYVVVCLVAMFLTMLLLMASLYAHMF

SEQ ID NO: 728 - protein, 226 aa, Sus scrofa
GLFVERAYYYAFVSPPSGIAETTFVGIILSRGTAASVSFMFSYILLTMCRNLITFLRETFLNHYVPFDAAVDFHRWIAMAALVLAILHSVGHVVNVYIFSVSPLSLLACVFPSVFVNDGSKLPQKFYWWFFQTIPGMTGVLLLVVLAIMYVFASPYFRRRSFRGFWLTHHFYILLYVLLIIHGSFALIQLPRFHIFFLVPALIYVGDKLVSLSRKKVEISVVKAEL

SEQ ID NO: 729 - protein, 101 aa, Solanum tuberosum
YPLSNYFHPTAFADKLLNTLGPRFLGPIAILRIWSFCLFYVMAELWGSVVVSVLFWGFANQITTVDEAKRFYPLFGLGANVALIFSGRTVKYFSSLRSSLG

SEQ ID NO: 730 - protein, 76 aa, Sus scrofa
PMPVLYGVFLYMGVASLNGVQFMDRLKLLLMPLKHQPDFIYLRHVPLRRVHLFTFLQVLCLALLWILKSTVAAIIF

SEQ ID NO: 731 - protein, 101 aa, Sus scrofa
MERGPVVGAGLGARARIRTLLGCLVKVLLWVASALLYFGSEQAARLLGSPCLRRLYHAWLAAVVIFGPLLQFHVNPRTIFASHGNFFNIKFVNSAWGWTCT

SEQ ID NO: 732 - protein, 176 aa, Sus scrofa
PGVHLDLGWIAILGAIWLLILADIHDFEIILHRVEWATLLFFAALFILMEALAHLHLIEYVGEQTALLIKMVPEDQRLAAAIIVVVWVSAIASSLIDNIPFTATMIPVLLNLSRDPEISLPAPPLMYALALGACLGGNGTLIGASANVVCAGIAEQHGYGFSFMEFFRLGFPMMVV

SEQ ID NO: 733 - protein, 101 aa, Solanum tuberosum
QLGYMMLALGMGSYRSALFHLITHAYSKALLFLGSGSIIHSMETIVGYSPAKSQNMGLMGGLRKHVPITKITFLLGTLSLCGIPPLACFWSKDEILNDSWL

SEQ ID NO: 734 - protein, 176 aa, Sus scrofa
MSGHNNSELFVLCSSSQLFLQPLWDHLKTWETLILSPFFPVFFSITTYLGFCLPFVVLDVLCPWVPALRRYKIHPDFSPSVWQLLPCLGLTLYQHVVFVFPMTLLHWAASPVLLPPEAPELLQLVRHIVLCLLLFDTEFFIWHVLHHKVPWLYRTFHKMHHQNSSSFALATQYMSV

SEQ ID NO: 735 - protein, 76 aa, Sus scrofa
MTALGITVALLVWLVTLLLISIWKHIHSSWKLPPGPFPLPIVGNIFQLDLKNIPKSFTMLAERYGPVFTVYLGSRR

SEQ ID NO: 736 - protein, 101 aa, Salmo salar
MDTLRIAVNGVSYNEASEIYKPHADPFTGPITNLAPWNFAVLATLMFVITSLSLFENFTVMLATYKFKQLRQPLNYIIVNLSLADFLVSLTGGTISFLTNA

SEQ ID NO: 737 - protein, 226 aa, Solanum tuberosum
PKFMGIELVTLKKIIPLGAMFFCILFNYTILRDTKDVLVVTAKGSSAEIIPFLKTWVNLPMAIGFMLLYTKLANVLSKEALFYTVILPFIAFFGAFGFVLYPLSNYFHPTAFADKLLNTLGPRFLGPIAILRIWSFCLFYVMAELWGSVVVSVLFWGFANQITTVDEAKRFYPLFGLGANVALIFSGRTVKYFSSLRSSLGPGVDGWAISLKGMMSIVVMMGGAIC

SEQ ID NO: 738 - protein, 126 aa, Sus scrofa
  MOD_RES (5)..(5): Any amino acid
RGSNXIFGDTPCRIMSYSMYVNMYSSIYFLTVLSVVRFLATVHPFRLLHTTSIKNAWILCGVIWIFIMASSTVLLKNGSEQKDNVTLCLELNSNKVTKLKTMNYVALVVGFVLPFGTLSICYLLII

SEQ ID NO: 739 - protein, 276 aa, Solanum tuberosum
TLAAWPVTRDSRLFHFLMLAMYSGQIGSFSSRDLLLFFIMWELELIPVYLLLAMWGGKKRLYSATKFILYTAGGSVFLLMGVLGVALYGSNEPTLNFETSVNQSYPVVLEIIFYIGFFIAFAVKSPIIPLHTWLPDTHGEAHYSTCMLLAGILLKMGAYGLIRINMELLPHAHSIFSPWLMIIGTIQIIYAASTSLGQRNLKKRIAYPSVSHMGFIIIGISSLTDTGLNGALLQIISHGFIGAALFFLAGTTYDRIRLVYLDEMGGIAIPMPKMFT

SEQ ID NO: 740 - protein, 76 aa, Sus scrofa
LGYYPSIMHRLPTYHNLSMSQKSASSLLDLIWLETILPKTTSFIQMKMSIMVSNQKGLIKLYFLSFLITIMISMTL

SEQ ID NO: 741 - protein, 76 aa, Salmo salar
WEIQQMFASSKELDLTLPLMGLILAATGKSAQFGLHPWLPSAMEGPTPVSALLHSSTMVVAGIFLLIRLHPLMENN

SEQ ID NO: 742 - protein, 251 aa, Sus scrofa
VSWRAVSWGLGLQFALGLFVIRTEPGFIAFQWLGDQIQIFLSYTEAGSSFVFGEALVKDVFAFQVLPIIVFFSCAMSVLYYVGLMQWVILKISWLMQATMGTTATETLSVAGNIFVSQTEAPLLIRPYLADMTLSEIHVVMTGGYATIAGSLLGAYISFGIDAASLIAASVMAAPCALALSKLVYPEVEESKFKREEGVKLTYGDAQNLLEAASSGAAMSVRVVTNIAANLIAFLAVLAFINAALSWLGDM

SEQ ID NO: 743 - protein, 226 aa, Solanum tuberosum
MIFQSFLLGNLVSLCMKIINSVVVVGLYYGFLTTFSIGPSYLFLLRALVMEEGTEKKVSATTGFITGQLMMFISIYYAPLHLALGRPHTITVLALPYLLFHFFWNNHKHFFDYGSTTRNSMRNLSIQCVFLNNLIFQLFNHFILPSSMLARLVNIYLFRCNNKILFVTSGFVGWLIGHILFMKWLGLVLVWIRQNHSIRSNKYIRSNKYLVLELRNSMARIFSILL

SEQ ID NO: 744 - protein, 101 aa, Sus scrofa
MAEAGTGFLEQLKSCIVWSWTYLWTVWFFIVLFLVYILRVPLKINDNLSTVSMFLNTLTPKFYVALTGTSSLISGLILIFEWWYFRKYGTSFIEQVSVSHL

SEQ ID NO: 745 - protein, 176 aa, Capra hircus
HETGSNNPTGIPSDTDKIPFHPYYTIKDILGAMLLILVLMLLVLFTPDLLGDPDNYTPANPLNTPPHIKPEWYFLFAYAILRSIPNKLGGVLALVLSILILVLVPFLHTSKQRSMMFRPISQCMFWILVADLLTLTWIGGQPVEHPYIIIGQLASIMYFLIILVMMPVASTIENNL

SEQ ID NO: 746 - protein, 101 aa, Sus scrofa
MAPALLLVPAALASFILAFGTGVEFVRFTSLRPLLGGIPESGGPDARQGWLAALQDQSILVPLAWDLGLLLLFVGQHSLMATETVKAWMSRYFGVLQRSLY

SEQ ID NO: 747 - protein, 76 aa, Solanum tuberosum
CLLSLGGLPPLAGFFGKLYLFWCGWQAGLYFLVLIGLLTSVVSIYYYLKIIKLLMTGRNQEITPHVRNYRRSPLRS

SEQ ID NO: 748 - protein, 76 aa, Solanum tuberosum; identical to SEQ ID NO: 747

SEQ ID NO: 749 - protein, 201 aa, Sus scrofa
YEFNGIFSVLMLAWIFLPIYIAGQVTTMPEYLRKRFGGSRIPITLAVLYLFIYIFTKISVDMYAGAIFIQQSLHLNLYLAIVGLLAITALYTIAGGLAAVIYTDALQTLIMLIGALTLMGYSFAAVGGMEGLKEKYFLALASNRSGNSSCGLPREDAFHIFRDPLTSDLPWPGILFGMSIPSLWYWCTDQVIVQRTLAAKN

SEQ ID NO: 750 - protein, 76 aa, Sus scrofa
MNIFDRKINFDALLKFSHITPSTQQHLKKVYASFALCMFVAAAGAYVHVVTRFIQAGLLSALGSLGLMIWLMATPH

SEQ ID NO: 751 - protein, 76 aa, Sus scrofa
MVLVWLLLLLTLLAGARLLWGQWKLRNLHLPPLVPGFLHLLQPNLPIYLLGLTQRLGPIYRLRLGLQDVVVLNSKR

SEQ ID NO: 752 - protein, 276 aa, Sus scrofa
LQWSTLVQGFLHTFHGGHIHIGVESMINADFCAGAVLISFGAILGKTGPAQLLLMALLEVVLFGLNEFVLLSLLGVKDAGGSMTIHTFGAYFGLVLSRVLYRPQLEKSKHRQSSVYHSDLFAMIGTIFLWIFWPSFNSAPTPLGDGQHRTALNTYYSLTASTLSTFALSALVGRDGRLDMVHVQNAALAGGVVVGTSAEMMLTPFGALAAGFLAGTVSTLGFKFFTPILESKFKIQDTCGVHNLHGMPGVLGALLGVLVAGLATHDSYGEGLESVF

SEQ ID NO: 753 - protein, 101 aa, Solanum tuberosum
GTAILTLLGGFHPQTQSLWLTDMAHHHLAIAFIFLVAGHMYRTNFGIGHSMKDLLDAHIPPGGRLGRGHKGLYDTINNSLHFQLGLALASLGVITSLVAQH

SEQ ID NO: 754 - protein, 176 aa, Sus scrofa
LQWSTLVQGFLHTFHGGHIHIGVESMINADFCAGAVLISFGAILGKTGPAQLLLMALLEVVLFGLNEFVLLSLLGVKDAGGSMTIHTFGAYFGLVLSRVLYRPQLEKSKHRQSSVYHSDLFAMIGTIFLWIFWPSFNSAPTPLGDGQHRTALNTYYSLTASTLSTFALSALVGRDG

SEQ ID NO: 755 - protein, 76 aa, Salmo salar
FHWPLGETLCKIVGLIFYINTYAGVNFMTCLSVDRFIAVVLPLRFARFRKVSNVRYICVGVWLLVLMQTLPLLSMP

SEQ ID NO: 756 - protein, 276 aa, Sus scrofa
PYGFTGTLAGAATCFYAFVGFDCIATTGEEVRNPQKAIPIGIVTSLLVCFMAYFGVSAALTLMMPYYVLDEKSPLPVAFEYVGWGPAKYVVAAGSLCALSTSLLGSMFPLPRILFAMARDGLLFRFLARVSKRQSPVAATLTAGVISAVMAFLFDLKALVDMMSIGTLLAYSLVAACVLILRYQPGLSYEQPKYCPEKEALGSCASAASKSKSQVTVLPEWGFSLRAFFSPSLLPTKQSASLVSFLVGFLAFLILGLSILTTYGVHAIARLEAWSL

SEQ ID NO: 757 - protein, 101 aa, Salmo salar
MYTIHFYVLFVLLTVRCSSSFIGNGENYRRNLSLELNPGLNSSLMPLPPGVGLLHVRALGKNNTLHYLLCSQGAPALLLVHTNSTSSKVKVDWPAFLVQNT

SEQ ID NO: 758 - protein, 101 aa, Sus scrofa
MVLEMLNPMNISSMVSEAVLFGSIAILLLIGLLLWVWNYEDTSSIPGPGYFLGIGPLISHFRFLWMGIGSACNYYNKMYGEFMRVWIGGEETLIISKSSSI

SEQ ID NO: 759 - protein, 76 aa, Sus scrofa
NQVYSTLYSMITVVGFFGNGFVLYVLIKTYHEKSAYQVYMINLAVADLLCVCTLPLRVVYYVHKGIWLFGDFLCRL

SEQ ID NO: 760 - protein, 151 aa, Sus scrofa
VYDTPGSSIVTEFNLVCEAAWKVDLFQSCVNVGFFVGSMGIGYIADRLVGSSASWPPPHQCRLGRPDAVAPDYVSLLVFRLLQGLVSKGSWMAGYTLITEFVGLGYRKTVAILYQTAFSVGLVLLSGLAYAVPHWRSLQLAVSLPIFLLLL

SEQ ID NO: 761 - protein, 201 aa, Sus scrofa
QKRYGGQRIRMYLSVLSLLLSIFTKISIDLYAGALFVHICLGWNFYLSTCLMLVITALYTIAGGLAAVIYTDALQTLIMVVGAVILTVKAFQQIGGYEQLAAAYAQAIPSKTISNTTCHLPRADAMHMFRDPATGDLPWTGMTFGLTIMATWYWCTDQVIVQRSLSARDLNHAKGGSILASYLKMLPMGLMVMPGMISRVL

SEQ ID NO: 762 - protein, 101 aa, Salmo salar
KCLFAFYGGETVYHKYLIGLQFYNVFLFFWCANFVTALGQMTLAGAFASYYWALVKPDDMPAFPIFSSLGRSLRYHTGSLAFGSLILSIIQIIRVLLEYID

SEQ ID NO: 763 - protein, 76 aa, Solanum tuberosum
MTIRNQRLSLLKQPISSILNQHLIDYPTPSNLSYWWGFGSLAGICLVIQIVTGVFLAMHYTPHVDLAFNSVEHIMR

SEQ ID NO: 764 - protein, 126 aa, Solanum tuberosum
RVLRHRDAIISHLNWACIFLGFHSFGLYIHNDTMSALGRPQDMFSDTAIQLQPVFAQWIQNTHALAPGATAPGATASTSLTWGGGDLVAVGGKVALLPIPLGTADFLVHHIHAFTIHVTVLILLKG

SEQ ID NO: 765 - protein, 151 aa, Sus scrofa
MARGCLCCLKYMMFLFNLIFWLCGCGLLGVGIWLSVSQGNFATFSPSFPSLSAANLVIAIGTIVMVTGFLGCLGAIKENRCLLLSFFIVLLIILLAELILIILFFVYMDKVNENARKDLKEGLLLYNSENNVGLKNAWNIIQAEMHCCGVT

SEQ ID NO: 766 - protein, 76 aa, Capra hircus
HYEKGSIPVLIIHIFLVFSFFLVFLIILFCNLVIIRTLLTQQVQMQRNAEVKRRALWMVCTVLAVFVICFVPHHLV

SEQ ID NO: 767 - protein, 101 aa, Sus scrofa
DLHWLSIVAACIGRMGITIVFQMVCLVSAELYPTFIRNLGVMVCSSLCDLGGVVAPFLVFRLTEVWRGLPLVLFAALGLVAGGMSLLLPETKGVALPETIE

SEQ ID NO: 768 - protein, 176 aa, Sus scrofa
MLNLTSQVPEPALNGTLPQSSSCFHSDWWNWLNTIQAPFLWVLFLLAALENIFVLSVFCLHKNSCTVAEIYLGNLAMADLILALGLPFWAITIANHFDWLFGEVLCRVVNTMIYMNLYSSICFLMLVSIDRYLALVKTMSMGRMRGVRWAKLYSLVIWGCTLLLSSPMLAFRTMHE

SEQ ID NO: 769 - protein, 201 aa, Sus scrofa
DTFNPCEDIMGHDILRVLIWFISILAITGNIIVLVILITSQYKLTVPRFLMCNLAFADLCIGIYLLLIASVDIHTKTQYHNYAIDWQTGAGCDAAGFFTVFASELSVYTLTAITLERWHTITHAMQLQCKVQLRHAASIMLVGWIFAFTVALFPIFGISSYMKVSICLPMDIDSPLSQLYVVSLLVLNVLAFVVICGCYTH

SEQ ID NO: 770 - protein, 226 aa, Salmo salar
MQVMRTFNQPPTSSHPTPTLNDSDTCITLYNHRGYARVLMPLFYCIVFFVGLLGNALAFHIIRPNVKKINSTTLYSANLVISDILFTLSLPLRIIYYALGFHWPLGETLCKIVGLIFYINTYAGVNFMTCLSVDRFIAVVLPLRFARFRKVSNVRYICVGVWLLVLMQTLPLLSMPMTNEEPDGFITCMEYPNFEPVPNISYILIGAVFLGYGVPVVTILVCYSIL

SEQ ID NO: 771 - protein, 276 aa, Solanum tuberosum
VTLCAVLLFAGAVAKSAQFPLHVWLPDAMEGPTPISALIHAATMVAAGIFLVARLLPLFRVIPYIMYLISVIGIITVLLGATLALAQKDIKRGLAYSTMSQLGYMMLALGMGSYRSALFHLITHAYSKALLFLGSGSIIHSMETIVGYSPAKSQNMGLMGGLRKHVPITKITFLLGTLSLCGIPPLACFWSKDEILNDSWLYSPIFAIIAWATAGLTAFYMFRIYLLTFEGHLNVHFQNYDGKHKTPFYSISLWGKNGVKKNSCLLTMNNNESTYF

SEQ ID NO: 772 - protein, 226 aa, Sus scrofa
DPSGRLCTFFGLTMTAFGLSSLFIASAMAVERALAIRAPHWYSSHMKTSATRAVLLGVWLAVLAFALLPVLGVGQYTIQWPGTWCFISTRTGGNETSSENNWGNIFFASAFSFLGLSALVVTFACNLATIKALVSRCRAKATASQSSAQWGRITTETAIQLMGIMCVLSVCWSPLLIMMLKTIFNQTSVEYCKVYTEKQNECNFFLIAVRLASLNQILDPWVYLLL

SEQ ID NO: 773 - protein, 176 aa, Sus scrofa
VNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATLVTQLLVYNGVYQYTSPDFLYVRSWLPCIFFAGGI

SEQ ID NO: 774 - protein, 176 aa, Salmo salar
WEIQQMFASSKELDLTLPLMGLILAATGKSAQFGLHPWLPSAMEGPTPVSALLHSSTMVVAGIFLLIRLHPLMENNQTALTTCLCLGALTTLFTATCALTQNDIKKIVAFSTSSQLGLMMVTIGLNQPQLAFLHICTHAFFKAMLFLCSGSIIHSLNDEQDIRKMGGMHNLTPFTS

SEQ ID NO: 775 - protein, 76 aa, Sus scrofa
YVACTALALQLVMRYWEPVPRGPVLWEAQAEPWATWVPLLCFVLHVISWLLIFSILLVFDYAELMGLKQVYYHVLG

SEQ ID NO: 776 - protein, 126 aa, Salmo salar
QNDIKKIVAFSTSSQLGLMMVTIGLNQPQLAFLHICTHAFFKAMLFLCSGSIIHSLNDEQDIRKMGGMHNLTPFTSSCLTIGSLALTGTPFLAGFFSKDAIIEALNTSHLNAWALTLTLLATSFTA

SEQ ID NO: 777 - protein, 226 aa, Sus scrofa
LSFADFCMGLYLLLIASVDAQTKGQYYNHAIDWQTGNGCSVAGFFTVFASELSVYTLTVITLERWHTITYAIQLDQKLRLRHAIPIMLGGWLFSTLIAMLPLVGVSSYMKVSICLPMDVETTLSQVYILTILILNVVAFIIICACYIKIYFAVQNPELMATNKDTKIAKKMAVLIFTDFTCMAPISFFAISAALKVPLITVTNSKVLLVLFYPVNSCANPFLYAIF

SEQ ID NO: 778 - protein, 276 aa, Sus scrofa
SVQETWLAALILLAVLEGILLLMLIFLRQRIRIAIALLEEASRAVGQMMSTLFYPLVTFVLLLVCIAYWAMTALYLATSGQPQYVLWAPNVSLAGCEKVMMNTSCDPMNQPVNSTCPGLMCVFQGYLSTGLVQRSLFNLQIYGVLGLFWTINWVLALGQCVLAGAFASFYWAFHKPRDIPTFPLSSAFIRTLRYHTGSLAFGALILTLVQIARAILEYIDHKLRGAQNPVARCIMCCFKCCLWCLEKFIKFLNRNAYIMIAIYGKNFCVSAKNAFM

SEQ ID NO: 779 - protein, 151 aa, Sus scrofa
FLMCNLAFADFCMGMYLLLIASVDLYTQSEYYNHAIDWQTGPGCNTAGFFTVFASELSVYTLTVITLERWYAITFAMRLDRKIRLRHAYAIMAGGWVCCFLLALLPLVGISSYAKVSICLPMDTETPLALAYIILVLLLNIVAFTIVCSCY

SEQ ID NO: 780 - protein, 101 aa, Sus scrofa
MASQTLVVFQASNQSQLPPPNATLCDGAQEAWHLLHKVLPTCVVAICSGGLLGNLFVLSVFLVPRRRLNAAEIYLAHLAASDLVFALGLPFWAETIRNGFH

SEQ ID NO: 781 - protein, 126 aa, Salmo salar
VTWSILEFASWYMHADPNMNRFFKYLLLFLIAMIILVTANNMFQLFIGWEGVGIMSFLLIGWWYGRADANTAAMQAVIYNRVGDIGLILSMAWFATNLNSWEIQQMFASSKELDLTLPLMGLILAA

SEQ ID NO: 782 - protein, 151 aa, Sus scrofa
NIAYPKLVMELMPTGLRGLMVAVMMAALMSSLTSIFNSSSTLFTMDVWRRLRPRAGERELLLVGRLVIVVLIGVSVAWIPVLQGSNSGQLFIYMQSVTSSLAPPVTAVFVLGIFWRRANEQGAFWGLMVGLAVGAWRLVLEFLHPAPPCGH

SEQ ID NO: 783 - protein, 151 aa, Sus scrofa
WNITVQWYAGEFLCKVLSYLKLFSMYAPAFMMVVISLDRSLAITRPLAVKSNSRLGRFMIGLAWLLSSIFAGPQLYIFRMIHLADSSGQTEGFSQCVTHGSFPQWWHQAFYNFFTFSCLFIIPLLIMLICNAKIMFTLTRVLQQDPHNLQL

SEQ ID NO: 784 - protein, 126 aa, Sus scrofa
GISGLLDSLNARDISVKIFEDFAQSWYWILAALGVALVLSLLFVLLLRLVAGPLVFVLIIGVLGVLAYGIYHCWNEYRLLRDKGASISQLGFTTNLSAYSSVQETWLAALILLAVLEGILLLMLIF

SEQ ID NO: 785 - protein, 101 aa, Solanum tuberosum
LNSSQLINGYNPFGMNSLSVWAWMFLFGHLVWATGFMFLISWRGYWQELIETLAWAHERTPLANLIRWRDKPVALSIVQARLVGLAHFSVGYIFTYAAFLI

SEQ ID NO: 786 - protein, 276 aa, Sus scrofa
TPFEISLWILLACLMKIGFHVIPTISSIVPESCLLIVVGLLVGGLIKAVGETPPFLQSEVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYDRVGIVDIVLGFLSFFVVSLGGVFVGVVYGVIAAFTSRFTSHIRVIEPLFVFLYSYMAYLSAELFHLSGIMALIASGVVMRPYVEANISHKSH

SEQ ID NO: 787 - protein, 101 aa, Sus scrofa
MESPAGRTPAPGALPYYVAFSQLLGLTVVAVTGAWLGAYRGGIAWESALQFNVHPLCMIIGLVFLQGDALLVYRVFRNEAKRTTKILHGLLHVLAFVIALV

SEQ ID NO: 788 - protein, 176 aa, Sus scrofa
YPQYYLAEPWQFSMLAAYMFMLIVLGFPINFLTLYVTVQHKKLRTPLNYILLNLAVADLFMVFGGFTTTLYTSLHGYFVFGPTGCNLEGFFATLGGEIALWSLVVLAIERYVVVCKPMSNFRFGENHAIMGLALTWVMALACAAPPLVGWSRYIPEGLQCSCGIDYYTLKPEVNNE

SEQ ID NO: 789 - protein, 151 aa, Sus scrofa
VLENLAVLVVLGRHPRFHAPMFLLLGSLTLSDLLAGAAYAANILLSGPLTLRLSPALWFAREGGVFVALAASVLSLLAIALERLLTMERRGPAPAARRGRTLALAAGAWGVSLLLGLLPALGWNCLGRLEACSTVLPLYAKAYVLFCVLAF

SEQ ID NO: 790 - protein, 176 aa, Meleagris gallopavo
LHESGSNNPLGISSNADKIPFHPYYSIKDILGLTIMLTPLLTLTLFSPNLLGDPENFTPANPLVTPPHIKPEWYFLFAYAILRSIPNKLGGVLALAASVLILLLIPFLHKSKQRAMTFRPLSQTLFWLLVANLLILTWVGSQPVEHPFIIIGQMASLSYFTILLILFPLIGALENK

SEQ ID NO: 791 - protein, 176 aa, Sus scrofa
IQWALLMQGWLHSFHSGYIVLGVENLINADFCVGSVCVAFGAVLGKVSPVQLLIMTLFQVTLFSVNEFILLNLLEVKDAGGSMTIHTFGAYFGLTVTWILYRPNLYQSKERQSSVYHSDLFAMIGTLFLWMYWPSFNSAVSHHGDAQHRAAINTYCSLAACVLTSVALSSALHKKG

SEQ ID NO: 792 - protein, 151 aa, Sus scrofa
TSVRHLDNVFDSMICISLVASMCSLLAVAVDRYVTIFYALRYQHLMTGRRCGAIIAGIWALCTGCGPVFIVYYESTYVVVCLVAMFLTMLLLMASLYAHMFLQARAHVRRIAALPGYRSARQRTSMKGAVTLAMLLGVFIVCWAPFFLHLI

SEQ ID NO: 793 - protein, 276 aa, Sus scrofa
CLLDFQRALALFVLFCVVLFFLAHSLLKRLLGPKLLRCVKPLRHPCLNLWFKRGLALAAFLGLVLWLVLDTAQRPEQLVSFGGICVFILLLFAGSKHHRAVSWRAVSWGLGLQFALGLFVIRTEPGFIAFQWLGDQIQIFLSYTEAGSSFVFGEALVKDVFAFQVLPIIVFFSCAMSVLYYVGLMQWVILKISWLMQATMGTTATETLSVAGNIFVSQTEAPLLIRPYLADMTLSEIHVVMTGGYATIAGSLLGAYISFGIDAASLIAASVMAAPC

SEQ ID NO: 794 - protein, 226 aa, Solanum tuberosum
GPSIAVISIFLSYSVIPFGDHLVLADLSIGVFFWIAISSIAPVGLLMSGYGSNNKYSFLGGLRAAAQSISYEIPLALCVLSISLLSNSSSTVDIVEAQSKYGFWGWNLWRQPIGFIVFLISSLAECERLPFDLPEAEEELVAGYQTEYSGIKFGLFYIASYLNLLVSSLFVTVLYLGGWNLSIPYIFVPELFGINKGGKVFGTLIGIFITLAKTYLFLFIPIATRW

SEQ ID NO: 795 - protein, 176 aa, Meleagris gallopavo
MGDGWLPPDCGPHNRSGGGGATAAPTGSRQVSAELLSQQWEAGMSLLMALVVLLIVAGNVLVIAAIGRTQRLQTLTNLFITSLACADLVMGLLVVPFGATLVVRGTWLWGSFLCECWTSLDVLCVTASIETLCVIAIDRYLAITSPFRYQSLMTRARAKVIICTVWAISALVSFLP

SEQ ID NO: 796 - protein, 176 aa, Sus scrofa
VTERLSPSFLDLFRTQNLRKYTFILMYLWFTSSVLYQGLIMHVGATGGSLYLDFLYSALVEFPAAFVILLIIDRFGRLYLLAGSNLLAGAACFFMIFISHDLHWLSIVAACIGRMGITIVFQMVCLVSAELYPTFIRNLGVMVCSSLCDLGGVVAPFLVFRLTEVWRGLPLVLFAA

SEQ ID NO: 797 - protein, 176 aa, Sus scrofa
MAGSSRRAGGRRLQLPLLCLLLQGATAILFAVFVRYNHETDAALWHWGNHSNPDNEFYFRYPSFQDVHTMIFVGFGFLMAFLQRYGFSSVGFTFLLAAFALQWSTLVQGFLHTFHGGHIHIGVESMINADFCAGAVLISFGAILGKTGPAQLLLMALLEVVLFGLNEFVLLSLLGV

SEQ ID NO: 798 - protein, 176 aa, Solanum tuberosum
ILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVLIGLLTSVVSIYYYLKIIKLLMTGRNQEITPHVRNYRRSPLRS

SEQ ID NO: 799 - protein, 176 aa, Solanum tuberosum; identical to SEQ ID NO: 798

SEQ ID NO: 800 - protein, 126 aa, Sus scrofa
MEFSMWYMHSDPFINRFFKYLVLFLITMMILVTANNLFQLFIGWEGVGIMSFLLIGWWHGRTDANTAALQAILYNRIGDIGFVLSMAWFLTHSNAWDLQQIFMLNNECPNMPLIGLLLAAAGKSAQ

SEQ ID NO: 801 - protein, 76 aa, Sus scrofa
VQAAVPGLPSRVKCGSPGQLQGHSIFAQDLRLCLDETLSWNCFGISLLAMALGLVVPMLHHLCGWDLWYCFHLCLA

SEQ ID NO: 802 - protein, 76 aa, Sus scrofa
MWVPSRRHLCLTFLLVCVLAAIFFLNVYQDLFYSGLDLLALCPDHNVVSSPVAIFCLAGTPVHPNASDSCPKHPAS

SEQ ID NO: 803 - protein, 126 aa, Salmo salar
MQVMRTFNQPPTSSHPTPTLNDSDTCITLYNHRGYARVLMPLFYCIVFFVGLLGNALAFHIIRPNVKKINSTTLYSANLVISDILFTLSLPLRIIYYALGFHWPLGETLCKIVGLIFYINTYAGVN

SEQ ID NO: 804 - protein, 76 aa, Solanum tuberosum
VNQSYPVVLEIIFYIGFFIAFAVKSPIIPLHTWLPDTHGEAHYSTCMLLAGILLKMGAYGLIRINMELLPHAHSIF

SEQ ID NO: 805 - protein, 126 aa, Solanum tuberosum
MIFQSFLLGNLVSLCMKIINSVVVVGLYYGFLTTFSIGPSYLFLLRALVMEEGTEKKVSATTGFITGQLMMFISIYYAPLHLALGRPHTITVLALPYLLFHFFWNNHKHFFDYGSTTRNSMRNLSI

SEQ ID NO: 806 - protein, 126 aa, Capra hircus
LEAGVLATRAAVVQQLDNVIDVLICSSMVSSLCFLGAIAVDRYISIFYALRYHSVVTLPRAWRIIAAIWVASILTSVLSITYYNHTVVLLCLVGFFIAMLALMAVLYVHMLARACQHARGIARLQK

SEQ ID NO: 807 - protein, 126 aa, Sus scrofa
KKVEVLFAGLVINTAGEMAGAFVAVFLLAMFYEGLKIAREGLLRKSQVSIRYNSMPVPGPNGTILMETHKTVGQQMLSFPHLLQTVLHIIQVVISYFLMLIFMTYNGYLCIAVAAGAGTGYFLFSW

SEQ ID NO: 808 - protein, 226 aa, Solanum tuberosum
MNVLSCSINTLKGLYDISGVEVGQHFYWQIGGFQVHGQVLITSWVVIAILLGSATIAVRNPQTIPTGGQNFFEYVLEFIRDVSKTQIGEEYGPWVPFIGTMFLFIFVSNWSGALLPWKIIQLPHGELAAPTNDINTTVALALLTSVAYFYAGLTKKGLGYFGKYIQPTPILLPINILEDFTKPLSLSFRLFGNILADELVVVVLVSLVPLVVPIPVMLLGLFTSGI

SEQ ID NO: 809 - protein, 76 aa, Salmo salar
FYHSSLSPTPELGGCWPPTGIITLDPFEVPLLNTAVLLASGVTVTWAHHSIMEGERKQTIQALTLTILLGFYFTFL

SEQ ID NO: 810 - protein, 226 aa, Salmo salar
QNDIKKIVAFSTSSQLGLMMVTIGLNQPQLAFLHICTHAFFKAMLFLCSGSIIHSLNDEQDIRKMGGMHNLTPFTSSCLTIGSLALTGTPFLAGFFSKDAIIEALNTSHLNAWALTLTLLATSFTAVYSLRVVFFVSMGHPRFTATAPINENNPSVINPIKRLAWGSIIAGLLITSNFLPSKTPIMTMPLPLKLAALLVTISGLLIALELASLTNKQFKTTPNLIT

SEQ ID NO: 811 - protein, 276 aa, Sus scrofa
WPGMIFGMTVVAAWYWCTDQVIVQRCLSGKDMSHVKAACIMCGYLKLLPMFLMVMPGMISRILYTEKVACVVPSECVKHCGTEVGCSNYAYPLLVMELMPSGLRGLMLSVMLASLMSSLTSIFNSASTLFTMDLYTKIRKQASEKELLIAGRLFIILLIVISIVWVPLVQVAQNGQLFHYIESISSYLGPPIAAVFLLAIFCKRVNEQGAFWGLIIGFVMGLIRMIAEFVYGTGSCLAASNCPQIICGVHYLYFALILFFVSILVVLAISLLTKPI

SEQ ID NO: 812 - protein, 126 aa, Sus scrofa
NNQALVATNPVSCKVFQFIHLYLMGCNYFWMLCEGIYLHTLIVVAVFAEKQHLMWYYFLGWGFPLIPACIHAVARRLYYNDNCWISSDTHLLYIIHGPICAALLVNLFFLLNIVRVLITKLKVTHQ

SEQ ID NO: 813 - protein, 76 aa, Sus scrofa
NLLSIFISTWLTAAGFIHLVENSGDPWENFQNNQALTYWECVYLLMVTMSTVGYGDVYAKTTLGRLFMVFFILGGL

SEQ ID NO: 814 - protein, 76 aa, Sus scrofa
FLFILGMGINIHSDYILRQLRKPGEVIYKIPQGGLFTYVSGANFLGEIIEWIGYALATWSLPALAFAFFSLCFLGL

SEQ ID NO: 815 - protein, 126 aa, Sus scrofa
GCVDPLAGLAANSSHLPLGPCRYGWVYDTPGSSIVTEFDLVCANSWLLDLFQSAVNVGFFIGSVGIGYIADRFGRKLCLLLTILINAVSGVLMAISPTYTWMLVFRLIQGLVSKAGWMIGYILITE

SEQ ID NO: 816 - protein, 76 aa, Sus scrofa
FVGLGYRKTVAILYQTAFSVGLVLLSGLAYAVPHWRSLQLAVSLPIFLLLLCYWFVPESPRWLLSQKRNTQAIKIM

SEQ ID NO: 817 - protein, 126 aa, Solanum tuberosum
ANFGWLIRSVHRWSASMMVLMMILHVFRVYLTGGFKKPRELTWVTGVVLAVLTASFGVTGYSLPWDQIGYWAVKIVTGVPDAIPVIGSPLVELLRGSASVGQSTLTRFYSLHTFVLPLLTAVFMLM

SEQ ID NO: 818 - protein, 76 aa, Sus scrofa
FVVCIIGLCGNTLVIYVILRYAKMKTITNIYILNLAIADELFMLGLPFLAMQVALVHWPFGKAICRVVMTVDGINQ

SEQ ID NO: 819 - protein, 126 aa, Sus scrofa
MNTSCDPMNQPVNSTCPGLMCVFQGYLSTGLVQRSLFNLQIYGVLGLFWTINWVLALGQCVLAGAFASFYWAFHKPRDIPTFPLSSAFIRTLRYHTGSLAFGALILTLVQIARAILEYIDHKLRGA

SEQ ID NO: 820 - protein, 101 aa, Solanum tuberosum
IPLALWLSLAPVVLGVSMASLTELSFNWLGFTSAMISNISFTYRSIYSKKAMTDMDSTNVYAYISIIALIFCLPPAIFIEGPQLLQHGFNDAIAKVGLTKF

SEQ ID NO: 821 - protein, 226 aa, Sus scrofa
GISGLLDSLNARDISVKIFEDFAQSWYWILAALGVALVLSLLFVLLLRLVAGPLVFVLIIGVLGVLAYGIYHCWNEYRLLRDKGASISQLGFTTNLSAYSSVQETWLAALILLAVLEGILLLMLIFLRQRIRIAIALLEEASRAVGQMMSTLFYPLVTFVLLLVCIAYWAMTALYLATSGQPQYVLWAPNVSLAGCEKVMMNTSCDPMNQPVNSTCPGLMCVFQGY

SEQ ID NO: 822 - protein, 176 aa, Sus scrofa
MSYTNAWALLMTLIATSLTAAYSTRIIFFAFLGKPRFPPLVLINENNPLLINSIKRLLIGSIFAGFIISNNIPPMTVPNTTMPLYMKMTALIVTIMGFMLALELNNTTYYLKFKYPSQTYKFSNMLGYYPSIMHRLPTYHNLSMSQKSASSLLDLIWLETILPKTTSFIQMKMSIM

SEQ ID NO: 823 - protein, 176 aa, Salmo salar
IIEALNTSHLNAWALTLTLLATSFTAVYSLRVVFFVSMGHPRFTATAPINENNPSVINPIKRLAWGSIIAGLLITSNFLPSKTPIMTMPLPLKLAALLVTISGLLIALELASLTNKQFKTTPNLITHNFSNMLGFFPAIIHRLAPKLNLTLGQTIASQMVDQTWFEKIGPKGVVST

SEQ ID NO: 824 - protein, 276 aa, Salmo salar
MHPTTLILSSTLLMIFALLLYPLITTLNPTPQQENWALTHVKTAIKMAFLVSLLPLFIFLDQGTETIVTNWQWMNTTTFDINLSFKFDHYSIIFTPIALYVTWSILEFASWYMHADPNMNRFFKYLLLFLIAMIILVTANNMFQLFIGWEGVGIMSFLLIGWWYGRADANTAAMQAVIYNRVGDIGLILSMAWFATNLNSWEIQQMFASSKELDLTLPLMGLILAATGKSAQFGLHPWLPSAMEGPTPVSALLHSSTMVVAGIFLLIRLHPLMENN

SEQ ID NO: 825 - protein, 176 aa, Salmo salar
MAHQAHAYHMVDPSPWPLTGAIAALLLTSGTAVWFHFHSLTLLTMGNILLLLTMYQWWRDIIREGTFQGHHTPPVQKGLRYGMILFITSEVFFFLGFFWAFYHSSLSPTPELGGCWPPTGIITLDPFEVPLLNTAVLLASGVTVTWAHHSIMEGERKQTIQALTLTILLGFYFTFL

SEQ ID NO: 826 - protein, 226 aa, Solanum tuberosum
LYGSSGGEIELQEIVNGLINTQMYNSPGISIALIFITVGIGFKLSPAPSHQWTPDVYEGSPTPVVAFLSVTSKVAASASATRIFDIPFYFSSNEWHLLLEILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQ

SEQ ID NO: 827 - protein, 226 aa, Solanum tuberosum; identical to SEQ ID NO: 826

SEQ ID NO: 828 - protein, 276 aa, Salmo salar
WEIQQMFASSKELDLTLPLMGLILAATGKSAQFGLHPWLPSAMEGPTPVSALLHSSTMVVAGIFLLIRLHPLMENNQTALTTCLCLGALTTLFTATCALTQNDIKKIVAFSTSSQLGLMMVTIGLNQPQLAFLHICTHAFFKAMLFLCSGSIIHSLNDEQDIRKMGGMHNLTPFTSSCLTIGSLALTGTPFLAGFFSKDAIIEALNTSHLNAWALTLTLLATSFTAVYSLRVVFFVSMGHPRFTATAPINENNPSVINPIKRLAWGSIIAGLLITS

SEQ ID NO: 829 - protein, 276 aa, Sus scrofa
VAQNGLDCPTPQVCVSSCPAVSWTVATNQLSQTVGQVFYAANRSFCLPGVPGDMPVHQSLSQELCPSFLLPSSPALGRCFPWPNSTVPEVPEISNTSISQGISGLLDSLNARDISVKIFEDFAQSWYWILAALGVALVLSLLFVLLLRLVAGPLVFVLIIGVLGVLAYGIYHCWNEYRLLRDKGASISQLGFTTNLSAYSSVQETWLAALILLAVLEGILLLMLIFLRQRIRIAIALLEEASRAVGQMMSTLFYPLVTFVLLLVCIAYWAMTALYL

SEQ ID NO: 830 - protein, 276 aa, Salmo salar
NGTLGVNSTVGASGELQAQYQPANFSAQVFFLFLSAMMVVCLAAFLLLNHHPAVAREKKCEQYFNGGLAEEKSDQALSLSHRPQEEKPMISSPDSHRRARQSSFGTGFYSGPELAFIFVVLAWVNALTNAVLPSVQSYSCLPYGNQAYHLAATMAAVANPVACFIAMFLPLRSLVLIGLLTIVGTGFGTYIMAMATLSPCPLLVHSASGTTLIVIAWVLFVLTLSYVKVIIGVILRDEGHSALVWCGAVVQLGSMLGALSMFPLVSVYGLFKSGDP

SEQ ID NO: 831 - protein, 201 aa, Sus scrofa
TECSEETPTTTSHSQAFNFWDLIRLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLF

SEQ ID NO: 832 - protein, 201 aa, Sus scrofa
GLYYGSYMFLETWNIGVVLLFTVMATAFMGYVLPWGQMSFWGATVITNLLSAIPYIGTDLVEWIWGGFSVDKATLTRFFAFHFILPFIITALAAVHLLFLHETGSNNPTGISSDMDKIPFHPYYTIKDILGALFMMLILLILVLFSPDLLGDPDNYTPANPLNTPPHIKPEWYFLFAYAILRSIPNKLGGVLALVASILIL

SEQ ID NO: 833 - protein, 151 aa, Sus scrofa
LLLLEAGALAAQAAVVQQLDNVMDVLICGSMVSSLCFLGAIAVDRYVSIFYALRYHSIVTLPRAGRAIAAIWAGSVLSSTLFIAYYHHTAVLLGLVSFFVAMLALMAVLYVHMLARACQHGRHIARLHKTQHPTRQGCGLKGAATLTILLG

SEQ ID NO: 834 - protein, 176 aa, Sus scrofa
GVLFMLAMSSLAVYSILWSGWASNSKYALIGALRAVAQTISYEVTLAIILLSVLLMNGSYTLSTLITTQEHIWMIFTSWPLAMMWFISTLAETNRAPFDLTEGESELVSGFNVEYAAGPFAMFFMAEYANIIMMNAFTAILFLGASHDPHTPELYTINFVLKTLALTITFLWIRAS

SEQ ID NO: 835 - protein, 76 aa, Sus scrofa
TPSYTVSCKLHSFLFETCSYATLLHVLTLSFERYIAICHPFRYKAMSGPCQVKLLIGFVWVTSTLVALPLLFAMGV

SEQ ID NO: 836 - protein, 176 aa, Sus scrofa
TPFEISLWILLACLMKIGFHVIPTISSIVPESCLLIVVGLLVGGLIKAVGETPPFLQSEVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHL

SEQ ID NO: 837 - protein, 176 aa, Sus scrofa
IFMLNNECPNMPLIGLLLAAAGKSAQFGLHPWLPSAMEGPTPVSALLHSSTMVVAGVFLLIRFYPLMETNKLVQTMTLCLGAITTLFTALCAITQNDIKKIVAFSTSSQLGLMMVTIGINQPHLAFLHICMHAFFKAMLFMCSGSIIHSLNDEQDIRKMGGLYKAMPFTTTALIIG

SEQ ID NO: 838 - protein, 101 aa, Sus scrofa
SGLRGLMLSVMLASLMSSLTSIFNSASTLFTMDLYTKIRKQASEKELLIAGRLFIILLIVISIVWVPLVQVAQNGQLFHYIESISSYLGPPIAAVFLLAIF

SEQ ID NO: 839 - protein, 76 aa, Capra hircus
ALMAVLYVHMLARACQHARGIARLQKRQRPIHQGFGLKGAATLTILLGVFFLCWGPFFLHLSLIVLCPQHPTCGCI

SEQ ID NO: 840 - protein, 276 aa, Salmo salar
MANLRKTHPLLKIANDALVDLPAPSNISVWWNFGSLLGLCLATQILTGLFLAMHYTSDISTAFSSVCHICRDVSYGWLIRNIHANGASFFFICIYMHIARGLYYGSYLYKETWNIGVVLLLLTMMTAFVGYVLPWGQMSFWGATVITNLLSAVPYVGGALVQWIWGGFSVDNATLTRFFAFHFLFPFVIAAATVLHLLFLHETGSNNPAGINSDADKISFHPYFSYKDLLGFVAMLLGLTSLALFAPNLLGDPDNFTPANPLVTPPHIKPEWYFLF

SEQ ID NO: 841 - protein, 226 aa, Solanum tuberosum
MTIRNQRLSLLKQPISSILNQHLIDYPTPSNLSYWWGFGSLAGICLVIQIVTGVFLAMHYTPHVDLAFNSVEHIMRDVEGGWLLRYMHANGASMFFIVVYLHIFRGLYYASYSSPREFVWCLGVVIFLLMIVTAFIGYVLPWGQMSFWGATVITSLASAIPVVGDTIVTWLWGGFSVDNATLNRFFSLHYLLPFILVGASLLHLAALHQYGSNNPLGVHSEMDKIA

SEQ ID NO: 842 - protein, 251 aa, Sus scrofa
MTNIRKSHPLMKIINNAFIDLPAPSNISSWWNFGSLLGICLILQILTGLFLAMHYTSDTTTAFSSVTHICRDVNYGWVIRYLHANGASMFFICLFIHVGRGLYYGSYMFLETWNIGVVLLFTVMATAFMGYVLPWGQMSFWGATVITNLLSAIPYIGTDLVEWIWGGFSVDKATLTRFFAFHFILPFIITALAAVHLLFLHETGSNNPTGISSDMDKIPFHPYYTIKDILGALFMMLILLILVLFSPDLLG

SEQ ID NO: 843 - protein, 226 aa, Sus scrofa
IVAFSTSSQLGLMMVTIGINQPHLAFLHICMHAFFKAMLFMCSGSIIHSLNDEQDIRKMGGLYKAMPFTTTALIIGSLALTGMPYLTGFYSKDLIIEAVNMSYTNAWALLMTLIATSLTAAYSTRIIFFAFLGKPRFPPLVLINENNPLLINSIKRLLIGSIFAGFIISNNIPPMTVPNTTMPLYMKMTALIVTIMGFMLALELNNTTYYLKFKYPSQTYKFSNML

SEQ ID NO: 844 - protein, 101 aa, Sus scrofa
EFYNQTWLHRYGESISPATLTTLWSLSVAIFSVGGMIGSFSVGLFVNRFGRRNSMLMMNLLAFISAVLMGFSKLGKSFEMLILGRFIIGVYCGLTTGFVPM

SEQ ID NO: 845 - protein, 201 aa, Sus scrofa
MASTLSPSTVTKTPGPPEISERIQNAADISVIVIYFVVVMAVGLWAMLRTNRGTVGGFFLAGRDVTWWPMGASLFASNIGSGHFVGLAGTGAASGIAIAAFEWNALLLLLVLGWFFVPIYIKAGVMTMPEYLRKRFGGKRLQIYLSILSLFICVALRISSDIFSGAIFIKLALGLDLYLAIFSLLAITAIYTITGGLASVI

SEQ ID NO: 846 - protein, 176 aa, Salmo salar
MHPTTLILSSTLLMIFALLLYPLITTLNPTPQQENWALTHVKTAIKMAFLVSLLPLFIFLDQGTETIVTNWQWMNTTTFDINLSFKFDHYSIIFTPIALYVTWSILEFASWYMHADPNMNRFFKYLLLFLIAMIILVTANNMFQLFIGWEGVGIMSFLLIGWWYGRADANTAAMQA

SEQ ID NO: 847 - protein, 76 aa, Sus scrofa
FYHSSLAPTPELGGCWPPTGIHPLNPLEVPLLNTSILLASGVSITWAHHSLMEGDRKHMIQALSITIALGVYFTLL

SEQ ID NO: 848 - protein, 76 aa, Sus scrofa
MFVNRWLYSTNHKDIGTLYLLFGAWAGMVGTALSLLIRAELGQPGTLLGDDQIYNVIVTAHAFVMIFFMVMPIMIG

SEQ ID NO: 849 - protein, 151 aa, Solanum tuberosum
GQLSIIFLWLSGMYFHGARFSNYEAWLSDPTHIGPSAQVVWPIVGQEILNGDVGGGFRGIQITSGFFQLWRASGITSELQLYCTAIGALVFAALMLFAGWFHYHKAAPKLAWFQDVESMLNHHLAGLLGLGSLSWAGHQVHVSLPINQFLN

SEQ ID NO: 850 - protein, 126 aa, Sus scrofa
IVAFSTSSQLGLMMVTIGINQPHLAFLHICMHAFFKAMLFMCSGSIIHSLNDEQDIRKMGGLYKAMPFTTTALIIGSLALTGMPYLTGFYSKDLIIEAVNMSYTNAWALLMTLIATSLTAAYSTRI

SEQ ID NO: 851 - protein, 76 aa, Sus scrofa
MAAPTLARLVLTHLLVALFGMGSWAAINGIWVELPVVVKDLPEGWSLPSYLSVLVALGNLGLLVVTLWRRLAPGKG

SEQ ID NO: 852 - protein, 276 aa, Sus scrofa
MPVLGPERRLLASLSSAPPAAPRLGLAANQTNQTGPQCLEVSIPDGLFLSLGLVSLVENVLVVAAIAKNRNLHSPMYYFVCCLAVSDLLVSVSNVLETAVLLLLEAGALAAQAAVVQQLDNVMDVLICGSMVSSLCFLGAIAVDRYVSIFYALRYHSIVTLPRAGRAIAAIWAGSVLSSTLFIAYYHHTAVLLGLVSFFVAMLALMAVLYVHMLARACQHGRHIARLHKTQHPTRQGCGLKGAATLTILLGVFLLCWAPFFLHLSLVVLCPQHPTC

SEQ ID NO: 853 - protein, 176 aa, Sus scrofa
MESLFPAPFWEVLYGSPLQGNLSLLSPNHSLLPPHLLLNASHGAFLPLGLKVTIVGLYLAVCVGGLLGNCLVMYVILRHTKMKTATNIYIFNLALADTAVLLTLPFQGTDVLLGFWPFGNALCKAVIAIDYYNMFTSAFTLTAMSVDRYVAICHPIRALDVRTSSKAQAVNVAIWA

SEQ ID NO: 854 - protein, 76 aa, Solanum tuberosum
ITGPSAILTQGFATSGILTEIHQSGILVPALQSEWLIMHVSMMILGYAALLCGSLLSVALLVITFRKNRKLFYKSN

SEQ ID NO: 855 - protein, 226 aa, Sus scrofa
TMTIKSLLRALMSMPAHYRCLCISHLIGWTAFLSNMLFFTDFMGQIVYHGDPYSAHNSTEFLIYQRGVEVGCWGLCINSVFSSLYSYFQKALVPYVGLKGLYFMGYLLFGLGTGFIGLFPNVYSTLVMCTSFGVMSSTLYTVPFNLIAMYHREEQEEQRQQAQGGGLDSSRRGQGLDCAALTCMVQLAQILVGGGLGFLVNVVGSVVVVVITASAAALIGCCFVAL

SEQ ID NO: 856 - protein, 226 aa, Salmo salar
VTWSILEFASWYMHADPNMNRFFKYLLLFLIAMIILVTANNMFQLFIGWEGVGIMSFLLIGWWYGRADANTAAMQAVIYNRVGDIGLILSMAWFATNLNSWEIQQMFASSKELDLTLPLMGLILAATGKSAQFGLHPWLPSAMEGPTPVSALLHSSTMVVAGIFLLIRLHPLMENNQTALTTCLCLGALTTLFTATCALTQNDIKKIVAFSTSSQLGLMMVTIGLN

SEQ ID NO: 857 - protein, 76 aa, Salmo salar
LLAFLVKMPVYGVHLWLPKAHVEAPIAGSMILAAVLLKLGGYGMMRMMVMLDPLTKELAYPFIVLALWGIIMTGSI

SEQ ID NO: 858 - protein, 226 aa, Solanum tuberosum
LILFPTATKSFRRMWAFQSVLLLSIVMIFSIYLSIQQINSSSVYQYVWSWIINNDFSLDFGYLIDPLTSIMSILITTVGIMVLIYSDNYMAHDQGYLRFFAYMSFFSTSMLGLVTSSNLIQIYIFWELVGLCSYLLIGFWFTRPVAANACQKAFVTNRVGDFGLLLGILGFYWITGSFEFRDLFEIFNNLIYNNEVNFLFVTLCAVLLFAGAVAKSAQFPLHVWLP

SEQ ID NO: 859 - protein, 151 aa, Salmo salar
MARGCLCCVKYMLFLFNLLFWLGGCGLLGVGVWLSVSQGSFATLSPSFPSISAANLIITLGAVIMVTGFLGCLGAIKENKCLLLSFFITLLVILLAELILLILFFVYTDNVSENARQDLKEGLALYSTNNNAGLRNAWNTIQTEWHCCGVN

SEQ ID NO: 860 - protein, 201 aa, Capra hircus
MPALGSPRRLLGSLNCTPPATLPLTLAPNRTGPQCLEVSIPDGLFLSLGLVSLVENVLVVAAIAKNRNLHSPMYYFICCLAMSDLLVSVSNVLETAVMLLLEAGVLATRAAVVQQLDNVIDVLICSSMVSSLCFLGAIAVDRYISIFYALRYHSVVTLPRAWRIIAAIWVASILTSVLSITYYNHTVVLLCLVGFFIAMLA

SEQ ID NO: 861 - protein, 276 aa, Sus scrofa
MFMINILSLIIPILLAVAFLTLVERKVLGYMQLRKGPNVVGPYGLLQPIADALKLFTKEPLRPATSSISMFIIAPILALSLALTMWVPLPMPYPLINMNLGVLFMLAMSSLAVYSILWSGWASNSKYALIGALRAVAQTISYEVTLAIILLSVLLMNGSYTLSTLITTQEHIWMIFTSWPLAMMWFISTLAETNRAPFDLTEGESELVSGFNVEYAAGPFAMFFMAEYANIIMMNAFTAILFLGASHDPHTPELYTINFVLKTLALTITFLWIRAS

SEQ ID NO: 862 - protein, 76 aa, Sus scrofa
VMTIFLVVLYKYRCYKFIHGWLITSSLMLLFLFTYIYLGEVLKTYNVAMDYPTLFLTVWNFGAVGMVCIHWKGPLV

SEQ ID NO: 863 - protein, 76 aa, Sus scrofa
FLQARAHVRRIAALPGYRSARQRTSMKGAVTLAMLLGVFIVCWAPFFLHLILMISCPQNLYCSCFMSHFNMYLILI

SEQ ID NO: 864 - protein, 151 aa, Sus scrofa
AVFGQAFYQQTNQAAFNICANSSLHDYAKIFPRNNLTVAVDFYQGGVILGCLFGPAALYIWAVGLLAAGQSSTMTGTYAGQFVMEGFLKLRWSRFARLLLTRSCAILPALLVAVFKELQDLSSLNDLLNVLQSLLLPFAVLPILTFTSMPA

SEQ ID NO: 865 - protein, 201 aa, Capra hircus
GLYYGSYTFLETWNIGVILLLATMATAFMGYVLPWGQMSFWGATVITNLLSAIPYIGTNLVEWIWGGFSVDKATLTRFFAFHFILPFIITALAMVHLLFLHETGSNNPTGIPSDTDKIPFHPYYTIKDILGAMLLILVLMLLVLFTPDLLGDPDNYTPANPLNTPPHIKPEWYFLFAYAILRSIPNKLGGVLALVLSILIL

SEQ ID NO: 866 - protein, 76 aa, Sus scrofa
DAAVDFHRLIASTAIILTVLHSAGHVVNVYLFSISPLSVLSCLFPGLFHDNGSEFPQKYYWWFFQTVPGLTGVMLL

SEQ ID NO: 867 - protein, 276 aa, Sus scrofa
IFMLNNECPNMPLIGLLLAAAGKSAQFGLHPWLPSAMEGPTPVSALLHSSTMVVAGVFLLIRFYPLMETNKLVQTMTLCLGAITTLFTALCAITQNDIKKIVAFSTSSQLGLMMVTIGINQPHLAFLHICMHAFFKAMLFMCSGSIIHSLNDEQDIRKMGGLYKAMPFTTTALIIGSLALTGMPYLTGFYSKDLIIEAVNMSYTNAWALLMTLIATSLTAAYSTRIIFFAFLGKPRFPPLVLINENNPLLINSIKRLLIGSIFAGFIISNNIPPMT

SEQ ID NO: 868 - protein, 76 aa, Sus scrofa
LSTLLGVPLALLWGFLFACISFCHIWAVVPCIKSYLIEIQCISHIYSLCIRTFCNPVFAALGQVCSNIKVMLRKEV

SEQ ID NO: 869 - protein, 251 aa, Capra hircus
MTNIRKTHPLMKIVNNAFIDLPTPSNISSWWNFGSLLGICLILQILTGLFLAMHYTSDTMTAFSSVTHICRDVNYGWIIRYMHANGASMFFICLFMHIGRGLYYGSYTFLETWNIGVILLLATMATAFMGYVLPWGQMSFWGATVITNLLSAIPYIGTNLVEWIWGGFSVDKATLTRFFAFHFILPFIITALAMVHLLFLHETGSNNPTGIPSDTDKIPFHPYYTIKDILGAMLLILVLMLLVLFTPDLLG

SEQ ID NO: 870 - protein, 176 aa, Sus scrofa
MTHQTHAYHMVNPSPWPLTGALSALLMTSGLTMWFHFNSMLLLSLGLLTNTLTMYQWWRDIIRESTFQGHHTSVVQKGLRYGMILFIISEVLFFTGFFWAFYHSSLAPTPELGGCWPPTGIHPLNPLEVPLLNTSILLASGVSITWAHHSLMEGDRKHMIQALSITIALGVYFTLL

SEQ ID NO: 871 - protein, 76 aa, Sus scrofa
AMLALMAVLYVHMLARACQHGRHIARLHKTQHPTRQGCGLKGAATLTILLGVFLLCWAPFFLHLSLVVLCPQHPTC

SEQ ID NO: 872 - protein, 76 aa, Meleagris gallopavo
MAPNIRKWHPLLKTINNSLIDLPTPSNISAWWNFGSLLAVCLITQILTGLLLAMHYTADTTLAFSSVAYTCRNVQY

SEQ ID NO: 873 - protein, 76 aa, Sus scrofa
VSPLSLLACVFPSVFVNDGSKLPQKFYWWFFQTIPGMTGVLLLVVLAIMYVFASPYFRRRSFRGFWLTHHFYILLY

SEQ ID NO: 874 - protein, 176 aa, Sus scrofa
MNIFDRKINFDALLKFSHITPSTQQHLKKVYASFALCMFVAAAGAYVHVVTRFIQAGLLSALGSLGLMIWLMATPHSHETEQKRLGLLAGFAFLTGVGLGPALDLCIAINPSILPTAFMGTAMIFTCFTLSALYARRRSYLFLGGILMSAMSLMVLSSLGNLFFGSIWLFQANLYV

SEQ ID NO: 875 - protein, 76 aa, Sus scrofa
QKRYGGQRIRMYLSVLSLLLSIFTKISIDLYAGALFVHICLGWNFYLSTCLMLVITALYTIAGGLAAVIYTDALQT

SEQ ID NO: 876 - protein, 76 aa, Meleagris gallopavo
ILLLIPFLHKSKQRAMTFRPLSQTLFWLLVANLLILTWVGSQPVEHPFIIIGQMASLSYFTILLILFPLIGALENK

SEQ ID NO: 877 - protein, 226 aa, Sus scrofa
MEFSMWYMHSDPFINRFFKYLVLFLITMMILVTANNLFQLFIGWEGVGIMSFLLIGWWHGRTDANTAALQAILYNRIGDIGFVLSMAWFLTHSNAWDLQQIFMLNNECPNMPLIGLLLAAAGKSAQFGLHPWLPSAMEGPTPVSALLHSSTMVVAGVFLLIRFYPLMETNKLVQTMTLCLGAITTLFTALCAITQNDIKKIVAFSTSSQLGLMMVTIGINQPHLAF

SEQ ID NO: 878 - protein, 76 aa, Sus scrofa
VNLMIRGVVLFFIGVFLALVLNLLQIQRNVTLFPPDVIASIFSSAWWVPPCCGTASAVIGLLYPCIDRHLGEPHKF

SEQ ID NO: 879 - protein, 101 aa, Sus scrofa
IISADEGAFAYIVNYFMYVLWALLFAFLAVSLVKVFAPYACGSGIPEIKTILSGFIIRGYLGKWTLIIKTITLVLAVSSGLSLGKEGPLVHVACCCGNILC

SEQ ID NO: 880 - protein, 76 aa, Sus scrofa
MGPRCTLHPLSLLVQVTALAAALAQGRLPAFLPCELQPHGLVNCNWLFLKSVPHFSAAAPRANVTSLSLLSNRIHH

SEQ ID NO: 881 - protein, 201 aa, Sus scrofa
MESSPSSPQPTQSDPLAVFPQRTLEPADIAVLVLYFLFVLAVGLWSTVKTRRDTVKGYFLAGGDMVWWPVGASLFASNVGSGHFVGLAGSGAAAGLSVTAYEFNGIFSVLMLAWIFLPIYIAGQVTTMPEYLRKRFGGSRIPITLAVLYLFIYIFTKISVDMYAGAIFIQQSLHLNLYLAIVGLLAITALYTIAGGLAAVI

SEQ ID NO: 882 - protein, 76 aa, Salmo salar
LMVVPILHTSKQRGLTFRPLTQFLFWTLVADMLILTWIGGMPVEHPFIIIGQIASVIYFTIFLVLAPLAGWAENKA

SEQ ID NO: 883 - protein, 226 aa, Sus scrofa
MNPFASLTLTTLIILTIPIMMSNSNIYKTNLYPNYVKTTVSYAFTLSLVPLLMFMHTGQEMIISNWHWMTLQTVELSLSFKMDYFSVMFIPVALFVTWSIMEFSMWYMHSDPFINRFFKYLVLFLITMMILVTANNLFQLFIGWEGVGIMSFLLIGWWHGRTDANTAALQAILYNRIGDIGFVLSMAWFLTHSNAWDLQQIFMLNNECPNMPLIGLLLAAAGKSAQ

SEQ ID NO: 884 - protein, 126 aa, Solanum tuberosum
AYMSFFSTSMLGLVTSSNLIQIYIFWELVGLCSYLLIGFWFTRPVAANACQKAFVTNRVGDFGLLLGILGFYWITGSFEFRDLFEIFNNLIYNNEVNFLFVTLCAVLLFAGAVAKSAQFPLHVWLP

SEQ ID NO: 885 - protein, 101 aa, Salmo salar
MTTTLITHIINPLAYIVPVLLAVAFLTLLERKVLGYMQLRKGPNIVGPYGLLQPIADGLKLFIKEPVRPSTSSPFLFLATPMLALTLALTLWAPMPIPYPI

SEQ ID NO: 886 - protein, 201 aa, Meleagris gallopavo
RGLYYGSYLYKETWNTGVVLLLTLMATAFVGYVLPWGQMSFWGATVITNLFSAIPYIGQTLVEWAWGGFSVDNPTLTRFFALHFLLPFVIAGITIIHLMFLHESGSNNPLGISSNADKIPFHPYYSIKDILGLTIMLTPLLTLTLFSPNLLGDPENFTPANPLVTPPHIKPEWYFLFAYAILRSIPNKLGGVLALAASVLI

SEQ ID NO: 887 - protein, 76 aa, Sus scrofa
IFGYLANRLGRRKVLILNYLQTAVSGTCAAFAPNFPVYCAFRLLSGMSLAGISLSCMTLNVEWMPIHTRACVGTLI

SEQ ID NO: 888 - protein, 176 aa, Sus scrofa
AVYFAVNMAVGVWSSCRASRNTVSGYFLAGRDMMWRPIGASLFASSEGSGLFVGLAGSGAAGGLAVAGFEWHATYVLLALAWVFVPIYISSEIVTMPEYIQKRYGGQRIRMYLSVLSLLLSIFTKISIDLYAGALFVHICLGWNFYLSTCLMLVITALYTIAGGLAAVIYTDALQT

SEQ ID NO: 889 - protein, 76 aa, Sus scrofa
SSAVLLTELTKLLLCALSLLVGWQAWPPRTPPWRQAAPFALSALLYGANNNLVIHLQHYMDPSTYQVLSNLKIGST

SEQ ID NO: 890 - protein, 201 aa, Salmo salar
VSLQMFLILAFGATEIIMFYIMFEATLLPTLIIITRWGNQTERLNAGTYFLFYTLAGSLPLLVALLLLQNDSGTLSMFTLQYTQPMHLLTWGNKLWWAACLLAFLVKMPVYGVHLWLPKAHVEAPIAGSMILAAVLLKLGGYGMMRMMVMLDPLTKELAYPFIVLALWGIIMTGSICLRQTDLKSLIAYSSVGHMGLVAGG

SEQ ID NO: 891 - protein, 101 aa, Sus scrofa
FASELSVYTLTAITLERWHTITHAMQLQCKVQLRHAASIMLVGWIFAFTVALFPIFGISSYMKVSICLPMDIDSPLSQLYVVSLLVLNVLAFVVICGCYTH

SEQ ID NO: 892 - protein, 76 aa, Sus scrofa
MALWLTLVIALTCFGGLASPGPVPPHSTALKELIEELVNITQNQKTPLCNGSMVWSVNLTTSMQYCAALESLINIS

SEQ ID NO: 893 - protein, 176 aa, Solanum tuberosum
VTLCAVLLFAGAVAKSAQFPLHVWLPDAMEGPTPISALIHAATMVAAGIFLVARLLPLFRVIPYIMYLISVIGIITVLLGATLALAQKDIKRGLAYSTMSQLGYMMLALGMGSYRSALFHLITHAYSKALLFLGSGSIIHSMETIVGYSPAKSQNMGLMGGLRKHVPITKITFLLG

SEQ ID NO: 894 - protein, 76 aa, Sus scrofa
DPSGRLCTFFGLTMTAFGLSSLFIASAMAVERALAIRAPHWYSSHMKTSATRAVLLGVWLAVLAFALLPVLGVGQY

SEQ ID NO: 895 - protein, 226 aa, Solanum tuberosum
AYMSFFSTSMLGLVTSSNLIQIYIFWELVGLCSYLLIGFWFTRPVAANACQKAFVTNRVGDFGLLLGILGFYWITGSFEFRDLFEIFNNLIYNNEVNFLFVTLCAVLLFAGAVAKSAQFPLHVWLPDAMEGPTPISALIHAATMVAAGIFLVARLLPLFRVIPYIMYLISVIGIITVLLGATLALAQKDIKRGLAYSTMSQLGYMMLALGMGSYRSALFHLITHAY

SEQ ID NO: 896 - protein, 276 aa, Meleagris gallopavo
MAPNIRKWHPLLKTINNSLIDLPTPSNISAWWNFGSLLAVCLITQILTGLLLAMHYTADTTLAFSSVAYTCRNVQYGWLLHNLHANGASFFFICIFLHIGRGLYYGSYLYKETWNTGVVLLLTLMATAFVGYVLPWGQMSFWGATVITNLFSAIPYIGQTLVEWAWGGFSVDNPTLTRFFALHFLLPFVIAGITIIHLMFLHESGSNNPLGISSNADKIPFHPYYSIKDILGLTIMLTPLLTLTLFSPNLLGDPENFTPANPLVTPPHIKPEWYFL

SEQ ID NO: 897 - protein, 151 aa, Sus scrofa
VCTVSGVLFIIYSDSSAVIICLITVFFTMLALMASLYVHMFLMARLHIKRIAVLPGTGTIRQGANMKGAITLTILIGVFVVCWAPFFLHLIFYISCPQNPYCVCFMSHFNLYLILIMCNSIIDPLIYALRSQELRKTFKEIICCYPLGGLC

SEQ ID NO: 898 - protein, 76 aa, Capra hircus
WVYHLTSAWMVFVVIASVFTNGLVLAATMRFKKLRHPLNWILVNLAIADLAETIIASTISVVNQMYGYFVLGHPLC

SEQ ID NO: 899 - protein, 176 aa, Sus scrofa
MLKIIIPTTMLLPMTWMSKHNMIWINATVHSLLISLISLSLLNQLGENSLNFSLTFFSDSLSAPLLVLTTWLLPLMLMASQSHLSKETTTRKKLYITMLILLQLFLIMTFTATELILFYILFEATLVPTLIIITRWGNQTERLNAGLYFLFYTLAGSLPLLVALVYIQNTTGSLNF

SEQ ID NO: 900 - protein, 176 aa, Salmo salar
ITDLNLGVLFVLALSSLAVYSILGSGWASNSKYALIGALRAVAQTISYEVSLGLILLSVIIFTGGFTLQTFNVAQESIWLLVPAWPLAAMWYISTLAETNRAPFDLTEGESELVSGFNVEYAGGPFALFFLAEYANILLMNTLSAILFLGASHIPAFPELTAVNLMTKAALLSVVF

SEQ ID NO: 901 - protein, 101 aa, Salmo salar
DVALGPLKQIPMNLFIMYMSGNTISIFPIMMVCMMAWRPIQALMSMSATFKLLENSNQQWLQGLVYSVGNLLGSALAIYKCQSMGLLPTHSSDWLAFIEPP

SEQ ID NO: 902 - protein, 76 aa, Sus scrofa
LFEISKYVIYKFLTVFLAIPLAFAAGILFATLSCLHIWIIIPFVKTCLMVLPSVQTIWKSVTDVVIAPLCTSAGRS

SEQ ID NO: 903 - protein, 126 aa, Sus scrofa
FFLAGRSMVWWPVGASLFASYIGSGHFVGLAGTGAAAGIATGGFEWNALIWVVVLGWLFVPIYIKAGVVTMPEYLRKRFGGKRIQVYLSILSLMLYIFTKISADIFSGAIFITLALGLDLYLAIFL

SEQ ID NO: 904 - protein, 76 aa, Salmo salar
IIEALNTSHLNAWALTLTLLATSFTAVYSLRVVFFVSMGHPRFTATAPINENNPSVINPIKRLAWGSIIAGLLITS

SEQ ID NO: 905 - protein, 76 aa, Salmo salar
TRAYFTSATMIIAIPTGVKVFSWLATLHGGSIKWETPLLWALGFIFLFTVGGLTGIVLANSSLDIVLHDTYYVVAH

SEQ ID NO: 906 - protein, 101 aa, Salmo salar
MLKILIPTLMLFPTIWFSPAKWLWTTSIAQSLVIALASLSWLKWSSETGWSSSNLYLATDPLSTPLLVLTCWLLPLMVLASQNHISPEPLNRQRTYISLLV

SEQ ID NO: 907 - protein, 76 aa, Capra hircus
LVLVPFLHTSKQRSMMFRPISQCMFWILVADLLTLTWIGGQPVEHPYIIIGQLASIMYFLIILVMMPVASTIENNL

SEQ ID NO: 908 - protein, 76 aa, Sus scrofa
TPFEISLWILLACLMKIGFHVIPTISSIVPESCLLIVVGLLVGGLIKAVGETPPFLQSEVFFLFLLPPIILDAGYF

SEQ ID NO: 909 - protein, 126 aa, Solanum tuberosum
FNILNKKIYNYFPYPYFVSVIHLAVGVVYCLVSWGVGLPKRAPIDSTQLKLLTPVAFCHALGHVTSNVSFAAVRVSFTHTVKALEPFFNAAASQFILGQQIPLALWLSLAPVVLGVSMASLTELSF

SEQ ID NO: 910 - protein, 76 aa, Sus scrofa
MLNLTSQVPEPALNGTLPQSSSCFHSDWWNWLNTIQAPFLWVLFLLAALENIFVLSVFCLHKNSCTVAEIYLGNLA

SEQ ID NO: 911 - protein, 201 aa, Salmo salar
GLYYGSYLYKETWNIGVVLLLLTMMTAFVGYVLPWGQMSFWGATVITNLLSAVPYVGGALVQWIWGGFSVDNATLTRFFAFHFLFPFVIAAATVLHLLFLHETGSNNPAGINSDADKISFHPYFSYKDLLGFVAMLLGLTSLALFAPNLLGDPDNFTPANPLVTPPHIKPEWYFLFAYAILRSIPNKLGGVLALLFSILVL

SEQ ID NO: 912 - protein, 76 aa, Sus scrofa
LAILALLAVTSIPSVSDSLTWREFHYIQSTLGIVSLLLGTIHALIFAWNKWVDIKQFIWYTPPTFMIAVFLPTVVL

SEQ ID NO: 913 - protein, 176 aa, Salmo salar
MANLRKTHPLLKIANDALVDLPAPSNISVWWNFGSLLGLCLATQILTGLFLAMHYTSDISTAFSSVCHICRDVSYGWLIRNIHANGASFFFICIYMHIARGLYYGSYLYKETWNIGVVLLLLTMMTAFVGYVLPWGQMSFWGATVITNLLSAVPYVGGALVQWIWGGFSVDNATLT

SEQ ID NO: 914 - protein, 176 aa, Salmo salar
LLAFLVKMPVYGVHLWLPKAHVEAPIAGSMILAAVLLKLGGYGMMRMMVMLDPLTKELAYPFIVLALWGIIMTGSICLRQTDLKSLIAYSSVGHMGLVAGGILIQTPWGFTGAIILMIAHGLASSALFCLANTSYERTHSRTMLLARGMQMILPLMTTWWFVASLANLALPPLPNL

SEQ ID NO: 915 - protein, 76 aa, Sus scrofa
LILMPMLHTSKQRGMMFRPLSQCLFWMLVADLITLTWIGGQPVEHPFIIIGQLASILYFLIILVLMPITSIIENNL

SEQ ID NO: 916 - protein, 76 aa, Sus scrofa
IFMLNNECPNMPLIGLLLAAAGKSAQFGLHPWLPSAMEGPTPVSALLHSSTMVVAGVFLLIRFYPLMETNKLVQTM

SEQ ID NO: 917 - protein, 126 aa, Solanum tuberosum
GPSIAVISIFLSYSVIPFGDHLVLADLSIGVFFWIAISSIAPVGLLMSGYGSNNKYSFLGGLRAAAQSISYEIPLALCVLSISLLSNSSSTVDIVEAQSKYGFWGWNLWRQPIGFIVFLISSLAEC

SEQ ID NO: 918 - protein, 76 aa, Sus scrofa
MSALSLVILGLLMAVPPASCQQGLGNLQPWMQGLIAVAVFLVLVAIAFAINHFWCQEEREPMNMVMTTGNKADGIL

SEQ ID NO: 919 - protein, 76 aa, Sus scrofa
LTFLWTEQAHSVTVLAVNSIGASSANFNLTFSWPMSKVNIVQSLSAYPLNSSCVGLSWLLSPSDYNLMYFILEWKI

SEQ ID NO: 920 - protein, 126 aa, Solanum tuberosum
LHIFRGLYYASYSSPREFVWCLGVVIFLLMIVTAFIGYVLPWGQMSFWGATVITSLASAIPVVGDTIVTWLWGGFSVDNATLNRFFSLHYLLPFILVGASLLHLAALHQYGSNNPLGVHSEMDKIA

SEQ ID NO: 921 - protein, 201 aa, Salmo salar
MTTTLITHIINPLAYIVPVLLAVAFLTLLERKVLGYMQLRKGPNIVGPYGLLQPIADGLKLFIKEPVRPSTSSPFLFLATPMLALTLALTLWAPMPIPYPITDLNLGVLFVLALSSLAVYSILGSGWASNSKYALIGALRAVAQTISYEVSLGLILLSVIIFTGGFTLQTFNVAQESIWLLVPAWPLAAMWYISTLAETNR

SEQ ID NO: 922 - protein, 201 aa, Salmo salar
MLKILIPTLMLFPTIWFSPAKWLWTTSIAQSLVIALASLSWLKWSSETGWSSSNLYLATDPLSTPLLVLTCWLLPLMVLASQNHISPEPLNRQRTYISLLVSLQMFLILAFGATEIIMFYIMFEATLLPTLIIITRWGNQTERLNAGTYFLFYTLAGSLPLLVALLLLQNDSGTLSMFTLQYTQPMHLLTWGNKLWWAACL

SEQ ID NO: 923 - protein, 176 aa, Salmo salar
MTLLTHVLACLFGMGSWVAINGIWVELPLIVPEIPEGWYLPSYLTVLIQMANVGPLFVTLMHRFRPGKLDERPVIYSIVGLGVVATFLLAFFWKHTVPLAGATHSVPLLVLCFLLSVVDCTSSVTFLPFMMRLGPQYLTTYFVGEGVSGLVPAVVALVQGVGVVHCRNATVASLAN

SEQ ID NO: 924 - protein, 76 aa, Sus scrofa
LSPLLLLFALWIRIGAKISNFTFGLTIIFHLGHAMLAMYVYWTQLNMFQTLKYLAILGSVTFLAGNRMLAQQAIKR

SEQ ID NO: 925 - protein, 76 aa, Salmo salar
MHPTTLILSSTLLMIFALLLYPLITTLNPTPQQENWALTHVKTAIKMAFLVSLLPLFIFLDQGTETIVTNWQWMNT

SEQ ID NO: 926 - protein, 101 aa, Sus scrofa
AYRQPILIAVVLQLSQQLSGINAVFYYSTSIFEKAGVQQPVYATIGSGIVNTAFTVVSLFVVERAGRRTLHLIGLAGMAGCAVLMTIALALLEQLPWMSYL

SEQ ID NO: 927 - protein, 76 aa, Solanum tuberosum
MFLFIFVSNWSGALLPWKIIQLPHGELAAPTNDINTTVALALLTSVAYFYAGLTKKGLGYFGKYIQPTPILLPINI

SEQ ID NO: 928 - protein, 126 aa, Salmo salar
MAITRWFFSTNHKDIGTLYLVFGAWAGMVGTALSLLIRAELSQPGALLGDDQIYNVIVTAHAFVMIFFMVMPIMIGGFGNWLIPLMIGAPDMAFPRMNNMSFWLLPPSFLLLLASSGVEAGAGTGW

SEQ ID NO: 929 - protein, 151 aa, Sus scrofa
LGVSLGAIFLVTVVLMGCELWATVIMCVTIAMILVNMFGVMWLWGISLNAVSLVNLVMSCGISVEFCSHITRAFTLSTKGSRVDRAEEALAHMGSSVFSGITLTKFGGIVVLAFAKSQIFQIFYFRMYLAIVLLGATHGLIFLPVLLSYIG

SEQ ID NO: 930 - protein, 76 aa, Salmo salar
PLLVHSASGTTLIVIAWVLFVLTLSYVKVIIGVILRDEGHSALVWCGAVVQLGSMLGALSMFPLVSVYGLFKSGDP

SEQ ID NO: 931 - protein, 276 aa, Sus scrofa
MFVNRWLYSTNHKDIGTLYLLFGAWAGMVGTALSLLIRAELGQPGTLLGDDQIYNVIVTAHAFVMIFFMVMPIMIGGFGNWLVPLMIGAPDMAFPRMNNMSFWLLPPSFLLLLASSMVEAGAGTGWTVYPPLAGNLAHAGASVDLTIFSLHLAGVSSILGAINFITTIINMKPPAMSQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWA

SEQ ID NO: 932 - protein, 276 aa, Sus scrofa
MLKIIIPTTMLLPMTWMSKHNMIWINATVHSLLISLISLSLLNQLGENSLNFSLTFFSDSLSAPLLVLTTWLLPLMLMASQSHLSKETTTRKKLYITMLILLQLFLIMTFTATELILFYILFEATLVPTLIIITRWGNQTERLNAGLYFLFYTLAGSLPLLVALVYIQNTTGSLNFLIIHYWSHPLSNSWSNIFMWLACIMAFMVKMPLYGLHLWLPKAHVEAPIAGSMVLAAVLLKLGGYGMMRITTILNPLTNYMAYPFLMLSMWGMIMTSSIC

SEQ ID NO: 933 - protein, 176 aa, Sus scrofa
MFMINILSLIIPILLAVAFLTLVERKVLGYMQLRKGPNVVGPYGLLQPIADALKLFTKEPLRPATSSISMFIIAPILALSLALTMWVPLPMPYPLINMNLGVLFMLAMSSLAVYSILWSGWASNSKYALIGALRAVAQTISYEVTLAIILLSVLLMNGSYTLSTLITTQEHIWMIF

SEQ ID NO: 934 - protein, 151 aa, Salmo salar
GILIQTPWGFTGAIILMIAHGLASSALFCLANTSYERTHSRTMLLARGMQMILPLMTTWWFVASLANLALPPLPNLMGELMIITSMFNWSHWTLLLTGLGTLITASYSLYLFLMTQRGPLPSHIIALEPTHTREHLLITLHLIPIILLILK

SEQ ID NO: 935 - protein, 76 aa, Capra hircus
MNENLFTSFITPMMLGLPLVTLIILFPSLLFPSSNRLINNRLVSLQQWALQLMSKQMMSIHNTKGQTWTLMLMSLI

SEQ ID NO: 936 - protein, 176 aa, Sus scrofa
SVQETWLAALILLAVLEGILLLMLIFLRQRIRIAIALLEEASRAVGQMMSTLFYPLVTFVLLLVCIAYWAMTALYLATSGQPQYVLWAPNVSLAGCEKVMMNTSCDPMNQPVNSTCPGLMCVFQGYLSTGLVQRSLFNLQIYGVLGLFWTINWVLALGQCVLAGAFASFYWAFHKP

SEQ ID NO: 937 - protein, 101 aa, Salmo salar
VSLQMFLILAFGATEIIMFYIMFEATLLPTLIIITRWGNQTERLNAGTYFLFYTLAGSLPLLVALLLLQNDSGTLSMFTLQYTQPMHLLTWGNKLWWAACL

SEQ ID NO: 938 - protein, 76 aa, Sus scrofa
WMLVFRLIQGLVSKAGWMIGYILITEFVGLSYRRTVGIFYQVAFTFGLLVLAGVAYALPHWRWLQFTVTLPNFCFL

SEQ ID NO: 939 - protein, 176 aa, Meleagris gallopavo
MAPNIRKWHPLLKTINNSLIDLPTPSNISAWWNFGSLLAVCLITQILTGLLLAMHYTADTTLAFSSVAYTCRNVQYGWLLHNLHANGASFFFICIFLHIGRGLYYGSYLYKETWNTGVVLLLTLMATAFVGYVLPWGQMSFWGATVITNLFSAIPYIGQTLVEWAWGGFSVDNPTL

SEQ ID NO: 940 - protein, 151 aa, Capra hircus
MAPWPPRNSSLTPWPDIPTLAPNTANASGLPGVPWAVALAGALLALAVLAIVGGNLLVIVAIARTPRLQTMTNVFVTSLATADLVVGLLVVPPGATLALTGHWPLGVTGCELWTSVDVLCVTASIETLCALAVDRYLAVTNPLRYGALVTK

SEQ ID NO: 941 - protein, 101 aa, Sus scrofa
YEFNGIFSVLMLAWIFLPIYIAGQVTTMPEYLRKRFGGSRIPITLAVLYLFIYIFTKISVDMYAGAIFIQQSLHLNLYLAIVGLLAITALYTIAGGLAAVI

SEQ ID NO: 942 - protein, 76 aa, Sus scrofa
LQWSTLVQGFLHTFHGGHIHIGVESMINADFCAGAVLISFGAILGKTGPAQLLLMALLEVVLFGLNEFVLLSLLGV

SEQ ID NO: 943 - protein, 76 aa, Sus scrofa
IQWALLMQGWLHSFHSGYIVLGVENLINADFCVGSVCVAFGAVLGKVSPVQLLIMTLFQVTLFSVNEFILLNLLEV

SEQ ID NO: 944 - protein, 276 aa, Salmo salar
SFWLLPPSFLLLLASSGVEAGAGTGWTVYPPLAGNLAHAGASVDLTIFSLHLAGISSILGAINFITTIINMKPPAISQYQTPLFVWAVLVTAVLLLLSLPVLAAGITMLLTDRNLNTTFFDPAGGGDPILYQHLFWFFGHPEVYILILPGFGMISHIVAYYSGKKEPFGYMGMVWAMMAIGLLGFIVWAHHMFTVGMDVDTRAYFTSATMIIAIPTGVKVFSWLATLHGGSIKWETPLLWALGFIFLFTVGGLTGIVLANSSLDIVLHDTYYVVAH

SEQ ID NO: 945 - protein, 76 aa, Sus scrofa
TILNLLIYITMTLAMFMLLIHSSATTTLSLSHTWNKMPVITSLMMVTLLSMGGLPPLSGFMPKWMIIQEMTKNESI

SEQ ID NO: 946 - protein, 76 aa, Sus scrofa
YPQYYLAEPWQFSMLAAYMFMLIVLGFPINFLTLYVTVQHKKLRTPLNYILLNLAVADLFMVFGGFTTTLYTSLHG

SEQ ID NO: 947 - protein, 76 aa, Sus scrofa
FCKRVNEQGAFWGLIIGFVMGLIRMIAEFVYGTGSCLAASNCPQIICGVHYLYFALILFFVSILVVLAISLLTKPI

SEQ ID NO: 948 - protein, 101 aa, Solanum tuberosum
MDLSEPIHDFLLVFLGSGLILGGLGVVLLPNPIYSAFSLGLVLICTSLFYILSNSYFVAAAQLLIYVGAINVLIIFAVMFMNGSEYYKDFHLWTVGDGITS

SEQ ID NO: 949 - protein, 176 aa, Sus scrofa
MAAPTLARLVLTHLLVALFGMGSWAAINGIWVELPVVVKDLPEGWSLPSYLSVLVALGNLGLLVVTLWRRLAPGKGERAPIQVVQALSVVGTALLAPLWQHLTVMAGQVHSVAFLALTFVLALACCASNVTYLPFLSRLPPPFLRSFFLGQGLSALLPCVLALGQGVGRLECPPAP

SEQ ID NO: 950 - protein, 126 aa, Sus scrofa
LLQLFLIMTFTATELILFYILFEATLVPTLIIITRWGNQTERLNAGLYFLFYTLAGSLPLLVALVYIQNTTGSLNFLIIHYWSHPLSNSWSNIFMWLACIMAFMVKMPLYGLHLWLPKAHVEAPIA

SEQ ID NO: 951 - protein, 176 aa, Sus scrofa
MAFMVKMPLYGLHLWLPKAHVEAPIAGSMVLAAVLLKLGGYGMMRITTILNPLTNYMAYPFLMLSMWGMIMTSSICLRQTDLKSLIAYSSVSHMALVIVAIMIQTPWSFMGATALMIAHGLTSSMLFCLANTNYERVHSRTMILARGLQTLLPLMATWWLMASLTNLALPPSINLI

SEQ ID NO: 952 - protein, 276 aa, Sus scrofa
SFWLLPPSFLLLLASSMVEAGAGTGWTVYPPLAGNLAHAGASVDLTIFSLHLAGVSSILGAINFITTIINMKPPAMSQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGGNIKWSPAMLWALGFIFLFTVGGLTGIVLANSSLDIVLHDTYYVVAH

SEQ ID NO: 953 - protein, 151 aa, Capra hircus
MNPIIFIIILMTVMLGTTIVMISSHWLRIWIGFEMNMLAIIPIMMKKHNPRATAASSDYFLTQSTASMLLMMAIIINLMFSGQWTVTKLFHPTASMLMTMALAMKLGMAPFHFWVPEVTQGIPLSSGLILLTWQKLVPMSVLYQILPSINL

SEQ ID NO: 954 - protein, 176 aa, Salmo salar
MNPYVLTILLSSLGLGTILTFASSHWLLAWMGLEINTLAIIPIMAQQSHPRAIEATTKYFLTQATAAAMILFASTTNAWLVGEWEIHQLSHPLATTTVMLALALKLGLAPVHFWLPEVLQGLELTTGLILSTWQKLAPFALMIQVAPTINSSLLIAMGLLSTLVGGWGGLNQTQLR

SEQ ID NO: 955 - protein, 176 aa, Sus scrofa
MFVNRWLYSTNHKDIGTLYLLFGAWAGMVGTALSLLIRAELGQPGTLLGDDQIYNVIVTAHAFVMIFFMVMPIMIGGFGNWLVPLMIGAPDMAFPRMNNMSFWLLPPSFLLLLASSMVEAGAGTGWTVYPPLAGNLAHAGASVDLTIFSLHLAGVSSILGAINFITTIINMKPPAM

SEQ ID NO: 956 - protein, 76 aa, Sus scrofa
MNPFASLTLTTLIILTIPIMMSNSNIYKTNLYPNYVKTTVSYAFTLSLVPLLMFMHTGQEMIISNWHWMTLQTVEL

SEQ ID NO: 957 - protein, 76 aa, Salmo salar
MTLSFFDQFMSPTYLGIPLIAVALTLPWILFPTPSTRWLNNRLITLQGWFINRFTQQLLLPLNLGGHKWAVLLTSL

SEQ ID NO: 958 - protein, 76 aa, Sus scrofa
MVLEMLNPMYYKITSMVSEVVPFASIAVLLLTGFLLLLWNYENTSSIPSPGYFLGIGPLISHFRFLWMGIGSACNY

SEQ ID NO: 959 - protein, 126 aa, Sus scrofa
IMIQTPWSFMGATALMIAHGLTSSMLFCLANTNYERVHSRTMILARGLQTLLPLMATWWLMASLTNLALPPSINLIGELFIITASFSWSNITIILMGMNMMITALYSLYMLITTQRGKYTHHINNI

SEQ ID NO: 960 - protein, 76 aa, Capra hircus
ALAMKLGMAPFHFWVPEVTQGIPLSSGLILLTWQKLVPMSVLYQILPSINLDLILTLSILSIMIGGWGGLNQTQLR

SEQ ID NO: 961 - protein, 176 aa, Sus scrofa
SFWLLPPSFLLLLASSMVEAGAGTGWTVYPPLAGNLAHAGASVDLTIFSLHLAGVSSILGAINFITTIINMKPPAMSQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWA

SEQ ID NO: 962 - protein, 226 aa, Salmo salar
MAITRWFFSTNHKDIGTLYLVFGAWAGMVGTALSLLIRAELSQPGALLGDDQIYNVIVTAHAFVMIFFMVMPIMIGGFGNWLIPLMIGAPDMAFPRMNNMSFWLLPPSFLLLLASSGVEAGAGTGWTVYPPLAGNLAHAGASVDLTIFSLHLAGISSILGAINFITTIINMKPPAISQYQTPLFVWAVLVTAVLLLLSLPVLAAGITMLLTDRNLNTTFFDPAGGG

SEQ ID NO: 963 - protein, 276 aa, Salmo salar
MNPYVLTILLSSLGLGTILTFASSHWLLAWMGLEINTLAIIPIMAQQSHPRAIEATTKYFLTQATAAAMILFASTTNAWLVGEWEIHQLSHPLATTTVMLALALKLGLAPVHFWLPEVLQGLELTTGLILSTWQKLAPFALMIQVAPTINSSLLIAMGLLSTLVGGWGGLNQTQLRKILAYSSIAHLGWMVLILQYAPSLTLLSLFLYIIMTSSAFLTLKTNNSLTINTLATSWTKSPTLAALTALVLLSLGGLPPLSGFMPKWLILQELTKQGLP

SEQ ID NO: 964 - protein, 76 aa, Sus scrofa
NLGMAIPLWSATVFTGFRYKTKTSLAHFLPQGTPALLIPMLVIIETISLFIQPVALAVRLTANITAGHLLIHLIGG

SEQ ID NO: 965 - protein, 76 aa, Capra hircus
NLGMAIPLWAGAVITGFRNKTKASLAHFYPQGTPTPLIPMLVIIETISLFIQPMALAVRLTANITAGHLLIHLIGG

SEQ ID NO: 966 - protein, 126 aa, Sus scrofa
LGSCASAASKSKSQVTVLPEWGFSLRAFFSPSLLPTKQSASLVSFLVGFLAFLILGLSILTTYGVHAIARLEAWSLALLVLFLVLCVAVVLTIWRQPQNQQKVAFMVPFLPFLPAFSILVNIYLMV

SEQ ID NO: 967 - protein, 76 aa, Sus scrofa
MVLEMLNPMHYKVTSMVSEVVPFASIAVLLLTGFLLLVWNYKNTSSIPGPGYFLGIGPLISYLRFLWMGIGSACNY

SEQ ID NO: 968 - protein, 176 aa, Salmo salar
SFWLLPPSFLLLLASSGVEAGAGTGWTVYPPLAGNLAHAGASVDLTIFSLHLAGISSILGAINFITTIINMKPPAISQYQTPLFVWAVLVTAVLLLLSLPVLAAGITMLLTDRNLNTTFFDPAGGGDPILYQHLFWFFGHPEVYILILPGFGMISHIVAYYSGKKEPFGYMGMVWA

SEQ ID NO: 969 - protein, 126 aa, Sus scrofa
TRSCAILPALLVAVFKELQDLSSLNDLLNVLQSLLLPFAVLPILTFTSMPALMQEFASGRVNKVITSSIMLLVCAINFYFLVSYLPSLPHPAYFGLVALLAVIYLGLTTYLVWTCLIAHGATLLVH

SEQ ID NO: 970 - protein, 76 aa, Salmo salar
ALALKLGLAPVHFWLPEVLQGLELTTGLILSTWQKLAPFALMIQVAPTINSSLLIAMGLLSTLVGGWGGLNQTQLR

SEQ ID NO: 971 - protein, 176 aa, Sus scrofa
ALAMKLGLSPFHFWVPEVTQGISLQAGLLLLTWQKLAPLSVLCQISQSINPNLMLTMAMLSILIGGWGGLNQTQLRKIMAYSSIAHMGWMTAVLPYNTTMTILNLLIYITMTLAMFMLLIHSSATTTLSLSHTWNKMPVITSLMMVTLLSMGGLPPLSGFMPKWMIIQEMTKNESI

SEQ ID NO: 972 - protein, 76 aa, Sus scrofa
SVLLDQWMFGKVMCHIMPFLQCVTVLVSTLILISIAIVRYHMIKHPVSNNLTANHGYFLIATVWTLGLAICSPLPV

SEQ ID NO: 973 - protein, 101 aa, Sus scrofa
GLYYGSYMFLETWNIGVVLLFTVMATAFMGYVLPWGQMSFWGATVITNLLSAIPYIGTDLVEWIWGGFSVDKATLTRFFAFHFILPFIITALAAVHLLFLH

SEQ ID NO: 974 - protein, 151 aa, Sus scrofa
MNPIIYTTLIMTVMSGTMLVMISSHWLLIWIGFEMNLLAMIPVLMKNFNPRATEAATKYFLTQATASMMLMMAIIINLLYSGQWTITKMFNPVAMTMMTMALAMKLGLSPFHFWVPEVTQGISLQAGLLLLTWQKLAPLSVLCQISQSINP

SEQ ID NO: 975 - protein, 76 aa, Sus scrofa
MAFMVKMPLYGLHLWLPKAHVEAPIAGSMVLAAVLLKLGGYGMMRITTILNPLTNYMAYPFLMLSMWGMIMTSSIC

SEQ ID NO: 976 - protein, 176 aa, Capra hircus
MNENLFTSFITPMMLGLPLVTLIILFPSLLFPSSNRLINNRLVSLQQWALQLMSKQMMSIHNTKGQTWTLMLMSLILFIGSTNLLGLLPHSFTPTTQLSMNLGMAIPLWAGAVITGFRNKTKASLAHFYPQGTPTPLIPMLVIIETISLFIQPMALAVRLTANITAGHLLIHLIGG

SEQ ID NO: 977 - protein, 76 aa, Sus scrofa
MLKIIIPTTMLLPMTWMSKHNMIWINATVHSLLISLISLSLLNQLGENSLNFSLTFFSDSLSAPLLVLTTWLLPLM

SEQ ID NO: 978 - protein, 101 aa, Meleagris gallopavo
RGLYYGSYLYKETWNTGVVLLLTLMATAFVGYVLPWGQMSFWGATVITNLFSAIPYIGQTLVEWAWGGFSVDNPTLTRFFALHFLLPFVIAGITIIHLMFL

SEQ ID NO: 979 - protein, 226 aa, Sus scrofa
LLQLFLIMTFTATELILFYILFEATLVPTLIIITRWGNQTERLNAGLYFLFYTLAGSLPLLVALVYIQNTTGSLNFLIIHYWSHPLSNSWSNIFMWLACIMAFMVKMPLYGLHLWLPKAHVEAPIAGSMVLAAVLLKLGGYGMMRITTILNPLTNYMAYPFLMLSMWGMIMTSSICLRQTDLKSLIAYSSVSHMALVIVAIMIQTPWSFMGATALMIAHGLTSSML

SEQ ID NO: 980 - protein, 176 aa, Salmo salar
ALALKLGLAPVHFWLPEVLQGLELTTGLILSTWQKLAPFALMIQVAPTINSSLLIAMGLLSTLVGGWGGLNQTQLRKILAYSSIAHLGWMVLILQYAPSLTLLSLFLYIIMTSSAFLTLKTNNSLTINTLATSWTKSPTLAALTALVLLSLGGLPPLSGFMPKWLILQELTKQGLP

SEQ ID NO: 981 - protein, 101 aa, Meleagris gallopavo
MTEALISAALNGTQPELLAGGWAAGNASTKCSLTKTGFQFYYLPTVYILVFITGFLGNSVAIWMFVFHMRPWSGISVYMFNLALADFLYVLTLPALIFYYF

SEQ ID NO: 982 - protein, 76 aa, Salmo salar
MNPYVLTILLSSLGLGTILTFASSHWLLAWMGLEINTLAIIPIMAQQSHPRAIEATTKYFLTQATAAAMILFASTT

SEQ ID NO: 983 - protein, 251 aa, Capra hircus
MNPIIFIIILMTVMLGTTIVMISSHWLRIWIGFEMNMLAIIPIMMKKHNPRATAASSDYFLTQSTASMLLMMAIIINLMFSGQWTVTKLFHPTASMLMTMALAMKLGMAPFHFWVPEVTQGIPLSSGLILLTWQKLVPMSVLYQILPSINLDLILTLSILSIMIGGWGGLNQTQLRKIMAYSSIAHMGWMTAILPYNPTMMLLNLIIYITMTSTMFLLFMANSTTTTLSLSLTWNKMPIMTTLVLITLLSM

SEQ ID NO: 984 - protein, 176 aa, Capra hircus
ALAMKLGMAPFHFWVPEVTQGIPLSSGLILLTWQKLVPMSVLYQILPSINLDLILTLSILSIMIGGWGGLNQTQLRKIMAYSSIAHMGWMTAILPYNPTMMLLNLIIYITMTSTMFLLFMANSTTTTLSLSLTWNKMPIMTTLVLITLLSMGGLPPLSGFVPKWMIIQEMTKNNSI

SEQ ID NO: 985 - protein, 101 aa, Sus scrofa
ASGPVPLHVTAPGLLLLLLYCLISGLSSVYTELLLKRQRLPLALQNLFLYTFGVLLNLGLHAGGGPGPGLLEGFSGWAALVVLSQALNGLLMSAVMKHGSS

SEQ ID NO: 986 - protein, 76 aa, Sus scrofa
GVLFMLAMSSLAVYSILWSGWASNSKYALIGALRAVAQTISYEVTLAIILLSVLLMNGSYTLSTLITTQEHIWMIF

SEQ ID NO: 987 - protein, 76 aa, Solanum tuberosum
VTLCAVLLFAGAVAKSAQFPLHVWLPDAMEGPTPISALIHAATMVAAGIFLVARLLPLFRVIPYIMYLISVIGIIT

SEQ ID NO: 988 - protein, 76 aa, Sus scrofa
ALAMKLGLSPFHFWVPEVTQGISLQAGLLLLTWQKLAPLSVLCQISQSINPNLMLTMAMLSILIGGWGGLNQTQLR

SEQ ID NO: 989 - protein, 176 aa, Salmo salar
MTLSFFDQFMSPTYLGIPLIAVALTLPWILFPTPSTRWLNNRLITLQGWFINRFTQQLLLPLNLGGHKWAVLLTSLMLFLITLNMLGLLPYTFTPTTQLSLNMGLAVPLWLATVIIGMRNQPTAALGHLLPEGTPVPLIPVLIIIETISLFIRPLALGVRLTANLTAGHLLIQLIA

SEQ ID NO: 990 - protein, 101 aa, Capra hircus
GLYYGSYTFLETWNIGVILLLATMATAFMGYVLPWGQMSFWGATVITNLLSAIPYIGTNLVEWIWGGFSVDKATLTRFFAFHFILPFIITALAMVHLLFLH

SEQ ID NO: 991 - protein, 251 aa, Sus scrofa
MNPIIYTTLIMTVMSGTMLVMISSHWLLIWIGFEMNLLAMIPVLMKNFNPRATEAATKYFLTQATASMMLMMAIIINLLYSGQWTITKMFNPVAMTMMTMALAMKLGLSPFHFWVPEVTQGISLQAGLLLLTWQKLAPLSVLCQISQSINPNLMLTMAMLSILIGGWGGLNQTQLRKIMAYSSIAHMGWMTAVLPYNTTMTILNLLIYITMTLAMFMLLIHSSATTTLSLSHTWNKMPVITSLMMVTLLSM

SEQ ID NO: 992 - protein, 76 aa, Sus scrofa
TLHGGNIKWSPAMLWALGFIFLFTVGGLTGIVLANSSLDIVLHDTYYVVAHFHYVLSMGAVFAIMGGFVHWFPLFS

SEQ ID NO: 993 - protein, 101 aa, Meleagris gallopavo
MTPLPAGNGSVPNCSWAAVLSRQWAVGAALSITILVIVAGNLLVIVAIAKTPRLQTMTNVFVTSLACADLVMGLLVVPPGATILLSGHWPYGTVVCELWTS

SEQ ID NO: 994 - protein, 76 aa, Sus scrofa
SNYVFVFLGLILYCVVTSPMLLVALAVFFGACYILYLRTLQSKFVLFGREVSPAHQYALAGGVSFPFFWLAGAGSA

SEQ ID NO: 995 - protein, 76 aa, Sus scrofa
MESLFPAPFWEVLYGSPLQGNLSLLSPNHSLLPPHLLLNASHGAFLPLGLKVTIVGLYLAVCVGGLLGNCLVMYVI

SEQ ID NO: 996 - protein, 101 aa, Salmo salar
GLYYGSYLYKETWNIGVVLLLLTMMTAFVGYVLPWGQMSFWGATVITNLLSAVPYVGGALVQWIWGGFSVDNATLTRFFAFHFLFPFVIAAATVLHLLFLH

SEQ ID NO: 997 - protein, 76 aa, Sus scrofa
SFWLLPPSFLLLLASSMVEAGAGTGWTVYPPLAGNLAHAGASVDLTIFSLHLAGVSSILGAINFITTIINMKPPAM

SEQ ID NO: 998 - protein, 151 aa, Salmo salar
QSSFGTGFYSGPELAFIFVVLAWVNALTNAVLPSVQSYSCLPYGNQAYHLAATMAAVANPVACFIAMFLPLRSLVLIGLLTIVGTGFGTYIMAMATLSPCPLLVHSASGTTLIVIAWVLFVLTLSYVKVIIGVILRDEGHSALVWCGAVVQ

SEQ ID NO: 999 - protein, 76 aa, Salmo salar
SFWLLPPSFLLLLASSGVEAGAGTGWTVYPPLAGNLAHAGASVDLTIFSLHLAGISSILGAINFITTIINMKPPAI

SEQ ID NO: 1000 - protein, 126 aa, Sus scrofa
RGACLLGLLATTSALTNGVLPAVQSYSSLPYGRLAYHLAVVLGSASNPLACFLAMGILCRSLAGLGGLSLLGTLFGAYLMALAILSPCPPLVGTSAGMVLVVVLWALCLGVFSYVKVATSSLLHGG

SEQ ID NO: 1001 - protein, 126 aa, Zea mays
MADRDRSGIYGGAHATYGQQQQQGGGGRPMGEQVKKGMLHDKGPTASQALTVATLFPLGGLLLVLSGLALTASVVGLAVATPVFLIFSPVLVPAALLIGTAVMGFLTSGALGLGGLSSLTCLANTA

SEQ ID NO: 1002 - protein, 126 aa, Zea mays
TLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLT

SEQ ID NO: 1003 - protein, 76 aa, Oryza sativa
PALAAGCTAVLKPSELASLTCLELGGICAEIGLPPGVLNIITGLGTEAGAPLASHPHVDKIAFTGSTETGKRIMIT

SEQ ID NO: 1004 - protein, 76 aa, Zea mays
VLDNEALYDICFRTLKLATPTFGDLNHLISATMSGVTCCLRFPGQLNSDLRKLAVNLIPFPRLHFFMVGFAPLTSR

SEQ ID NO: 1005 - protein, 76 aa, Zea mays
TSTGAAKAVSLVLPNLKGKLNGIALRVPTPNVSVVDLVVQVSKKTLAEEVNQAFRDAAANELTGILEVCDVPLVSV

SEQ ID NO: 1006 - protein, 76 aa, Zea mays
VLDNEALYDICFRTLKLTNPSFGDLNHLISATMSGVTCCLRFPGQLNSDLRKLAVNLIPFPRLHFFMVGFAPLTSR

SEQ ID NO: 1007 - protein, 76 aa, Zea mays
VLDNEALYDICFRTLKLTTPSFGDLNHLISATMSGVTCCLRFPGQLNSDLRKLAVNLIPFPRLHFFMVGFAPLTSR

SEQ ID NO: 1008 - protein, 76 aa, Zea mays; identical to SEQ ID NO: 1007

SEQ ID NO: 1009 - protein, 76 aa, Zea mays; identical to SEQ ID NO: 1007

SEQ ID NO: 1010 - protein, 76 aa, Zea mays; identical to SEQ ID NO: 1007

SEQ ID NO: 1011 - protein, 76 aa, Zea mays; identical to SEQ ID NO: 1007

SEQ ID NO: 1012 - protein, 151 aa, Zea mays
TDGRPTQGGFASTMVVDQKFVVKIPAGLAPEQAAPLLCAGVTVYSPLKHFGLTNPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGV

SEQ ID NO: 1013 - protein, 176 aa, Oryza sativa
TDGRPTQGGFASAMVVDQKFVVKIPAGLAPEQAAPLLCAGLTVYSPLKHFGLMSPGLRGGVLGLGGVGHMGVKVAKSMGHHVTVISSSARKRGEAMDDLGADAYLVSSDAAAMAAAGDSLDYIIDTVPVHHPLEPYLALLKLDGKLILMGVINQPLSFISPMVMLGRKAITGSFIG

SEQ ID NO: 1014 - protein, 76 aa, Oryza sativa
PAGLPLDSAAPLLCAGVTVYSPMVIHGLNAPGKHVGVVGLGGLGHVAVKFAKAFGMRVTVISTSPGKRQEALEHLG

SEQ ID NO: 1015 - protein, 76 aa, Zea mays
DALKLKVCAKVLGLVKVGLPQYEQCCPLLEGLVDLDAALCLCTAIKANVLGIHLNVPLSLNFILNNCGRICPEDFT

SEQ ID NO: 1016 - protein, 76 aa, Oryza sativa
LPLDGAAPLLCAGVTVYSPMVIHGLNAPGKHVGVVGLGGLGHVAVKFAKAFGMRVTVISTSPGKRREALEHLGADE

SEQ ID NO: 1017 - protein, 126 aa, Oryza sativa
LDKGAPLLCAGITVYSPMKYHGLNVPSKHVGVLGLGGLGHVAVKFAKAFGMTVTVISSSPGKRQEALERLGADAFVVSKNADEMNAATGTMDGIINTVSANIPIAPLLGLLKPNGKMILVGLPEKP

SEQ ID NO: 1018 - protein, 76 aa, Solanum lycopersicum
QELQNEKKLAEDLKFEIKGLQNDLMNTKEDKKKLQEELKEKLDLIQVLEEKITLLTTEIKDKEVSLRSNTSKLAEK

SEQ ID NO: 1019 - protein, 126 aa, Oryza sativa
PDTLPLDAAAPLLCAGITVYSPMKQHGMLQADAAGRRLGVVGLGGLGHVAVKFGKAFGLHVTVISTSPAKEREARENLKADNFVVSTDQKQMQAMTRSLDYIIDTVAATHSLGPILELLKVNGKLV

SEQ ID NO: 1020 - protein, 126 aa, Zea mays
NQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQ

SEQ ID NO: 1021 - protein, 126 aa, Oryza sativa
DGYPLEKAAPLLCAGITVYSPMMRHNMNQPGKSLGVIGLGGLGHMAVKFGKAFGLKVTVISTSESKRKEAIDLLGADNFVVSSDENQMETLKSSLNFIIDTASGDHPFDPYLTLLKVGGVMALLSF

SEQ ID NO: 1022 - protein, 176 aa, Zea mays
ILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRS

SEQ ID NO: 1023 - protein, 176 aa, Zea mays; identical to SEQ ID NO: 1022

SEQ ID NO: 1024 - protein, 126 aa, Solanum lycopersicum
VLGTFLLWFGWYGFNPGSFLTILKSYDHTIRGTYYGQWSAIGRTAVTTTLAGCTAALTTLFCKRLLVAHWNVVDVCNGLLGGFAAITSGCAVVEPWAAIVCGFIAAWVLIGFNALAAKLKYDDPLE

SEQ ID NO: 1025 - protein, 126 aa, Oryza sativa
ADYPLSKAAPLLCAGITVYTPMIRHNMNQPGKSLGVIGLGGLGHMAVKFGKAFGLKVTVFSTSESKREEAINLLGADNFVISSDENQMESLKSSLHFIIDTASGDHQFDPYLSLLKVGGVMVLLSF

SEQ ID NO: 1026 - protein, 226 aa, Oryza sativa
QFYHTETGTDSKEIFSAALPTLLDEIICFPGESDQIETDRRMAKISPTIQNIARILTGNDNLPEFLKNDFVRLLNSIDKKMLHSSDVNLQKQALQRIRKLVEMMGPYLSTHAPKIMVLLIFAIDKETLQMDGLDVLHFFIKRLAEVSCTSIKYVMSQVVAAFIPSLERCRERPLVHLGKIVEILEELVVKNIILLKQHIRELPLLPSLPSLSGVNKVIQEARGLMT

SEQ ID NO: 1027 - protein, 101 aa, Zea mays
METSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPL

SEQ ID NO: 1028 - protein, 101 aa, Zea mays
VETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPL

SEQ ID NO: 1029 - protein, 176 aa, Solanum lycopersicum
LFVGRVAMIGFAASLLGEAITGKGILAQLNLETGIPIYEAEPLLLFFILFNLLGAIGALGDRGKFVDDPTPPTGLEKAVIPPGKSFKSALGLSEGGPLFGFTKANELFVGRLAQLGIAFSIIGEIITGKGALAQLNFETGVPINEIEPLLLFNIAFFFFAAINPGTGKFITDEEED

SEQ ID NO: 1030 - protein, 101 aa, Oryza sativa
VEMMGPYLSTHAPKIMVLLIFAIDKETLQMDGLDVLHFFIKRLAEVSCTSIKYVMSQVVAAFIPSLERCRERPLVHLGKIVEILEELVVKNIILLKQHIRE

SEQ ID NO: 1031 - protein, 201 aa, Oryza sativa
VEMMGPYLSTHAPKIMVLLIFAIDKETLQMDGLDVLHFFIKRLAEVSCTSIKYVMSQVVAAFIPSLERCRERPLVHLGKIVEILEELVVKNIILLKQHIRELPLLPSLPSLSGVNKVIQEARGLMTLQDHLKDAVNGLNHESLNVRYMVACELNKLFNDRRGDITSLIIGEDIADLDIISSLIMSLLKGCAEESRTVVGQR

SEQ ID NO: 1032 - protein, 76 aa, Solanum lycopersicum
IEGKKVITLDMGLLVAGTKYRGEFEERLKKLMEEIKQSDEIILFIDEVHTLIGAGAAEGAIDAANILKPALARGEL

SEQ ID NO: 1033 - protein, 76 aa, Solanum lycopersicum
LLGLIGEGTGIAAKVLKSMGINLKDARVEVEKIIGRGSGFIAVEIPFTPRAKRVLELSLEEARQLGHNYIGSEHLL

SEQ ID NO: 1034 - protein, 76 aa, Zea mays
MRVLLVALALLALAASATSTHTSGGCGCQPPPPVHLPPPVHLPPPVHLPPPVHLPPPVHLPPPVHLPPPVHVPPPV

SEQ ID NO: 1035 - protein, 76 aa, Zea mays
MSSSPSFGLLAVAALLLALSLAQHGSLAATVGPRVIVVGAGMSGISAAKRLSEAGITDLLILEATDHIGGRMHKTN

SEQ ID NO: 1036 - protein, 76 aa, Oryza sativa
TVLGKLKELAKRLKLKVKKKDNGVLRLAAPKEGKKGFLELDAEIFEVTPSFLLVELKKTNGDTMEYRKLVKEDIRP

SEQ ID NO: 1037 - protein, 76 aa, Zea mays
GVLKDELSVVENHINNLHVDTASDLDLSVDKQLKLEKGSLGHVFRMSKKEEQKVRKKLTGSYLIIETRKDGVKFTN

SEQ ID NO: 1038 - protein, 76 aa, Zea mays
LNEQLKAIKKELGLETDDKTALSAKFRERIESKKDKCPPHVLQVIEEELTKLQLLEASSSEFSVTRNYLDWLTVLP

SEQ ID NO: 1039 - protein, 76 aa, Oryza sativa
AAAIFAKLNELARRFKLKIKKKENGVLRLVAPKEGIKGLLELDAEVFELAPSFHLVEFKKSNGDTIEYQKLMKEDI

SEQ ID NO: 1040 - protein, 101 aa, Solanum lycopersicum
PELCYSAIVNVSDFSKKVTSQKDVIELSLNITVKAVRRNYYAVKELIKTRKGLTPREKVALHDCLETMDETLDELHTAVEDLELYPNKKSLKEHVEDLKTL

SEQ ID NO: 1041 - protein, 76 aa, Oryza sativa
DRNKILSLRFDDQIRREIGTLKLLKHPNVVRLHEVAASKTKIYMVLEYVNGGELFDKIAVKGKLSEHEGRRLFQQL

SEQ ID NO: 1042 - protein, 76 aa, Zea mays
KRRKRLTEIEVQCYTLQLICGLKYLHSRRVIHRDLKLGNLLLNDKMELKICDFGLAAKLEFDGEKRKTVCGTPNYI

SEQ ID NO: 1043 - protein, 76 aa, Zea mays
GVLLRDQHGIPLVKSVTGSKILRILKAHGLAPEIPEDLYFLIKKAVAIRKHLERNRKDKDSKFRLILVESRIHRLA

SEQ ID NO: 1044 - protein, 101 aa, Oryza sativa
KRLNLLEQKFNLHLMVNADRELLAQKAAPHRDFYNVRKVDTHVHHSACMNQKHLLRFIKSKLRKEPDEVVIFRDGTYLTLKEVFESLDLTGYDLNVDLLDV

SEQ ID NO: 1045 - protein, 76 aa, Oryza sativa
QEDRVEFFVSLPVALARCSVVKEDTGHMLDKQKLKTFKVNVRLVSKLCGEDLNKYLNEDKDGIPLPQDYLHALDVV

SEQ ID NO: 1046 - protein, 76 aa, Solanum lycopersicum
DCRLIGLHLYDGLFKVIPFDNKGQLKEAFNIRLEELQVLDIKFLYGCPKPTIVVLYQDNKDARHVKTYEVSLKDKD

SEQ ID NO: 1047 - protein, 76 aa, Oryza sativa
QLHQTADCCEKAFLDTEKKKLILESTKGYICDAIVAVIDHLGTVSSKLEQQLQEKIEITQTEKKLNFLKQRLLTCE

SEQ ID NO: 1048 - protein, 76 aa, Oryza sativa
GMMKERMAEPERPCEDFFDHVIQELRREKPLLTETIALDLMFVLLFASFETTALALTIGVKLLTENPKVVDALREE

SEQ ID NO: 1049 - protein, 76 aa, Solanum lycopersicum
SYGVVLLELLTGKQPTDSADFGDNNLVGWVKLHAKGKITDVFDRELLKEDASIEIELLQHLKVACACLDDRHWKRP

SEQ ID NO: 1050 - protein, 101 aa, Zea mays
QKLDELGKMITSLDPGDSIVIAKSLSHMLNLANLAEEVQIAYRRRIKLKKGDFADENSAITESDIEETLKRLVVDLKKSPAEVFDALKSQTVDLVLTAHPT

SEQ ID NO: 1051 - protein, 151 aa, Zea mays
KIGTEPTIRKYSKGRMLGKGGFAKCYEVTNLENKKVLAGKIICKASLTKSRAKQKLISEIKIHKSLRHSNIVEFEHVFEDQENVYILLELCPNQSLHDLIKRRKRLTEIEVQCYTLQLICGLKYLHSRRVIHRDLKLGNLLLNDKMELKIC

SEQ ID NO: 1052 - protein, 76 aa, Solanum lycopersicum
EILLFLSRIESHGKGILKPHELLAEFDAIRQDDKDKLNEHAFEELLKSTQEAIVLPPWVALAIRLRPGVWEYVRVN

SEQ ID NO: 1053 - protein, 76 aa, Solanum lycopersicum
AVMLVHIIPDLLSVKTRELFLKNKAAELDREMGLIRTQEETGRYVRMLTHEIRSTLDRHTILKTTLVELGRALQLE

SEQ ID NO: 1054 - protein, 151 aa, Oryza sativa
DLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKI

SEQ ID NO: 1055 - protein, 126 aa, Oryza sativa
ERAALKKIKLDDGKEGFPRQILREIKLLKKLDHENIIRLKEIVVSPGTAHGAGGSDDYMYRGDIYMVFEYMDHDLKKVLHHSTPSQVKYYMEQLLKGLHYCHVNNVLHRDIKGANLLISGGGKLLK

SEQ ID NO: 1056 - protein, 76 aa, Oryza sativa
RLGKYKEGVNFTALREIKLLKELKDSNIIELIDAFPYKGNLHLVFEFMETDLEAVIRDRNIVLSPADTKSYIQMML

SEQ ID NO: 1057 - protein, 76 aa, Zea mays
SAGQLKGKFFNKDRQSARDYLLDKLKDDKDKDIVRGMGTYTLECVAIHVLSKLFNVFSLEKTSVLAAALISELDIT

SEQ ID NO: 1058 - protein, 101 aa, Zea mays
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEV

SEQ ID NO: 1059 - protein, 76 aa, Oryza sativa
IIDDGLIHKEELQLALFKTPSGQNLFLDRVFDLFDEKKNGVIEFDEFIHALSVFHPLAPLEDKINFAFRLYDLRQT

SEQ ID NO: 1060 - protein, 101 aa, Oryza sativa
MVQCLDGVRQLLAVVFKCCDLELKQPRGLEDPQVLARETVFSVSEVEALYELFKKISSAVIDDGLINKEEFQLALFKTSKKESLFADRVFDLFDTKHNGIL

SEQ ID NO: 1061 - protein, 76 aa, Zea mays
ADTAMTGEMTLRGLVLPVGGVKDKVLAAHRYGIKRVILPERNLKDLSEVPLPILSDMEILLVKRIEEVLDHAFEGR

SEQ ID NO: 1062 - protein, 76 aa, Solanum lycopersicum
RDVDLENIEDGSLTLEKEDFFLGSVIDAVVSQVMLLLREKGVQLIRDIPEEIKTLTVHGDQVRIQQVLADFLLNMV

SEQ ID NO: 1063 - protein, 76 aa, Oryza sativa
GLTVEETKEMRKKGLYVPVLTKLAKNGYYASLVPMVRDAFLTDELVRIDSKGLPKSDYRKIGVKLRDLVPCIIVSF

SEQ ID NO: 1064 - protein, 101 aa, Zea mays
KVGKEGVITIADGNTLYNELEVVEGMKLDRGYISPYFITNSKTQKCELEDPLILIHDKKVTNMHAVVKVLEMALKKQKPLLIVAEDVESEALGTLIINKLR

SEQ ID NO: 1065 - protein, 76 aa, Oryza sativa
MLQCLEGVKQLCGVLLKCCDLDLKQPKGLEDPEILARETVFSVSEVEALYELFKKISSAVIDDGLINKEEFQLALF

SEQ ID NO: 1066 - protein, 101 aa, Zea mays
KVGKEGVITIADGNTLYNELEVVEGMKLDRGYISPYFITNSKAQKCELEDPLILIHDKKVTNMHAVVKVLEMALKKQRPLLIVAEDVESEALGTLIINKLR

SEQ ID NO: 1067 - protein, 76 aa, Solanum lycopersicum
KVLNECLNEITRALLQADVQFKLVRDMSTNIKKIVNLEDLAAGHNKRRIIQQAVYNELCKILDPGKPAFTLKKGKP

SEQ ID NO: 1068 - protein, 76 aa, Zea mays
MKKKKALPSFLYLVFIVLLPWGVSFSFNKCLELWIKNWWNTRQSETFLTDIQEKRILEGFIELEELFLLDEMIKEK

SEQ ID NO: 1069 - protein, 76 aa, Oryza sativa
TEDGLAIEGPEFREKSLDELLKLIPKIQVMARSSPLDKHTLVKHLRTTFNEVVAVTGDGTNDAPALHEADIGLAMG

SEQ ID NO: 1070 - protein, 76 aa, Zea mays
QHLIYITGWSVYTEITLVRDTNRPKPGGDVTLGELLKRKASEGVRVLMLVWDDRTSVGLLKKDGLMATHDEETANY

SEQ ID NO: 1071 - protein, 101 aa, Solanum lycopersicum
LADEVDREAGLSRLTLFSPCKINVFLRITSKRDDGYHDLASLFHVISLGDKIKFSLSPSKSKDRLSTNVAGVPLDERNLIIKALNLYRKKTGTDNYFWIHL

SEQ ID NO: 1072 - protein, 76 aa, Zea mays
YESLGQLKNKFINIDEQTAKDYLLDKLEKPDDLDIVRAMGTYTLECIVVFVLSKQFNVFALDKASVQVATLVSELD

SEQ ID NO: 1073 - protein, 101 aa, Zea mays
GPYHVARVSRLDMTKTELEQAEQDPDLIALSRQFKATAMELISVLEQKQKTVGRTKVLLDTVPVYRLADIFVASFEISFEEQLSMLDSVHLKVRLSKATEL

SEQ ID NO: 1074 - protein, 76 aa, Oryza sativa
LKDVILVSYEIIHKKDPAAGQRIKQKEVYDQQKELILLAERVVLATLGFDLNVHHPYKPLVEAIRKFKVAQNALAQ

SEQ ID NO: 1075 - protein, 126 aa, Oryza sativa
LDRLNELRTSHRDVMVDVVMDVLRALASPNLDVKRKVLDLVLDLLTARNVEEVVLYLKKEVVKTQAGELEKSGEYRQMLVQAIHACAVEYPEVAGSVVHLLMDFLGDTNVAAAVDVVLFVREIIET

SEQ ID NO: 1076 - protein, 76 aa, Oryza sativa
PLKDVILISYEIIHKKDAAAVQRIKQKEVYEQQKELILLGERVVLVTLGFDLNVHHPYKPLVEAIKKFKVAQNALA

SEQ ID NO: 1077 - protein, 126 aa, Oryza sativa
KDTILNHRMLHQIKREISIMKIVRHPNIVRLNEVLAGKTKIYIILELITGGELFDKIARQGKLRENEARKYFQQLIDAINYCHSKGVYHRDLKPENLLLDSRGNLKVSDFGLSTLAQKGVGLLHTT

SEQ ID NO: 1078 - protein, 176 aa, Zea mays
FLVLRIQTFSRFKDLVTSTNELVSVLAVLIIHVPVRLRNFDIKDSSYFGKKSDRGVSLIASLCEKHHTSEDELSKALEKTNTLIMDILKKKPCPATSACQQDNLSFIDPEGLTVFKDLLQGDSLKPSLIILEKEYENAINTKGELDERMFANDEDSLLGSGSLSGGAINLPGTKRK

SEQ ID NO: 1079 - protein, 76 aa, Oryza sativa
LDIISSLIMSLLKGCAEESRTVVGQRLKLVCADCLGALGAVDPAKFKVMSCERFKIECSDDDLIFELIHKHLARAF

SEQ ID NO: 1080 - protein, 76 aa, Oryza sativa
MKKKKALPSFLYLVFIVLLPWGVSFSFNKCLELWIKNWWNTRQSQTLLTAIQEKRVLERFMELEDLFILDEMIKEK

SEQ ID NO: 1081 - protein, 176 aa, Oryza sativa
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTL

SEQ ID NO: 1082 - protein, 101 aa, Oryza sativa
MEADIAKMEFDLKGTAIICRSGSPLILADLKKVSVSKARAIVVLAEEGNADQSDARALRTVLSLTGVKEGLRGHIVVELSDLDNEVLVKLVGGDLVETVVA

SEQ ID NO: 1083 - protein, 76 aa, Zea mays
FLVLRIQTFSRFKDLVTSTNELVSVLAVLIIHVPVRLRNFDIKDSSYFGKKSDRGVSLIASLCEKHHTSEDELSKA

SEQ ID NO: 1084 - protein, 76 aa, Zea mays
NTFLLPRDVLAATDHLIGMKFGTGILDDDDMNHLKNKRIRSVADLLQDQFGLALGRLQHAVQKTIRRVFIRQSKPT

SEQ ID NO: 1085 - protein, 76 aa, Solanum lycopersicum
LALVARKLLLNSVIVLEQEEELDLVIDISRKMSVRPVIGLRAKLRTKHSGHFGSTSGEKGKFGLTTTQILRVVKKL

SEQ ID NO: 1086 - protein, 76 aa, Solanum lycopersicum
VMTTPKALTALVSCITALMLVHIIPDLLSVKTRELFLKKKAAQLDREMGIIRTQEETGRHVRMLTHEIRSTLDRHT

SEQ ID NO: 1087 - protein, 76 aa, Zea mays
GTLHLIGLLSDGGVHSRLDQLQLLLKGVSERGAKKIRVHILTDGRDVLDGSSIGFVETLENDLLELRAKGVDAQIA

SEQ ID NO: 1088 - protein, 101 aa, Oryza sativa
DSDDDDDKNDDEYMLLAEARQPLWRKVPIPSSKINPYRIVIVLRLVVLCFFLKFRITTPAMDAVPLWLASVICELWFALSWILDQLPKWSPVTRETYLDRL

SEQ ID NO: 1089 - protein, 76 aa, Solanum lycopersicum
GPEKVTNEIPHLEAHLLRNLDKKGIVMLGSWVETGDILVGKLTPQVVKESSYAPEDRLLRAILGIQVSTSKETCLK

SEQ ID NO: 1090 - protein, 76 aa, Zea mays
VASEDMDSLTFGAPRFLRHLMDPSSKKIPVMEFDVAKVLEELELTMDQFIDLCILCGCDYCDSIKGIGGQTALKLI

SEQ ID NO: 1091 - protein, 76 aa, Solanum lycopersicum
SLRFFSLILEIAPVAKNMFSFLKDSDELPENNPKLRAHAVKVFKMTCESAIQLREKGEVVVGETTLKYLGSIHLQK

SEQ ID NO: 1092 - protein, 76 aa, Oryza sativa
PQNPVKLSSLKHHSGVLYCLEVTKNYDDSTAVTVDQDVEALLGELNFIPGTVFTTDLPYVDFLDRVHKAELKLRGK

SEQ ID NO: 1093 - protein, 76 aa, Solanum lycopersicum
VLGTLSLPINLPNTNYHRGFQARKIIVNLLRTLIEERRASKEIQHDMLGYLMNEEATRFKLTDDEMIDLIITILYS

SEQ ID NO: 1094 - protein, 76 aa, Solanum lycopersicum
ANTTLAHYCRDNGLLLHIHRAMHAVIDRQKNHGIHFRVLAKALRMSGGDHIHSGTVVGKLEGERDITLGFVDLLRD

SEQ ID NO: 1095 - protein, 76 aa, Zea mays
PNAARSITVPDLVKENTKLLTLLNEKTKIIDLSRVEIYKLRLALQASKQQNLHLTQTNSQMLAEINTGKDRIKMLQ

SEQ ID NO: 1096 - protein, 76 aa, Oryza sativa
LKFIKCTPCKSTLIKAEVPLSIQRGIISGKDEVLKTLKSILNTFSPKMFDLQKGQLIETRISSADILKDVINLIFE

SEQ ID NO: 1097 - protein, 201 aa, Zea mays
LSELASKGVLSCASQEVRDLYNLLEHRFLPLDLASKVQPLLLKISKIGGKLSSASSVPEVKLSQYISALEKLTTLRVLQQASCIFKSIKIDMLSRMIPFFDFSVVEKISVDAAKQNFVAIKVDHLSGVVQFGTVDIESDGLSDHLSVLADSLNKARIHICPPVKKPSKLGESLISLAAIVENEHKRLLARKSIIEKRKEEL

SEQ ID NO: 1098 - protein, 101 aa, Solanum lycopersicum
ELLKLDDVIDLVIPRGSNKLVSQIKASTKIPVLGHADGICHVYVDKSADMDMAKRITVDAKIDYPAACNAMETLLVHKDLAQNGGLNDLIVELQTKGVSLY

SEQ ID NO: 1099 - protein, 76 aa, Oryza sativa
AVETLLESIFNNTSGEVVTNQDGKYQILGTPTETALLEFALLLDGDCKEKQLGSKIVKVEPFNSTKKRMSTILELP

SEQ ID NO: 1100 - protein, 76 aa, Zea mays
EFRTHKVIYRRYAGLFFSICVDITDNELAYLECIHLFVEILDHFFSNVCELDLVFNFHKVYRYLILDEFILAGELQ

SEQ ID NO: 1101 - protein, 76 aa, Solanum lycopersicum
LVLTIIKESLKTDPLRYTKMKERLVGVSEETTTGVKKLYQMPANGSLLFLPINVNDSVTKSKFDNLYGCRHSLPDG

SEQ ID NO: 1102 - protein, 76 aa, Oryza sativa
KLLYLLNQGETFTKVEATEVFFAVTKLFQSKDAGLRRLVYLMIKELSPSSDEVIIVTSSLMKDMNSKTDMYRANAI

SEQ ID NO: 1103 - protein, 76 aa, Oryza sativa
LSLLLQGIFENTSAEVVKEKDGKQTVLGTPTERAILEFGLGLEGVHDAEYSACTKVKVEPFNSVKKKMAVLISLPS

SEQ ID NO: 1104 - protein, 101 aa, Zea mays
REVNRLLDTLGPRFVDWWWDTPLPVDADLLPEFVPGSKTPYRLCPPGVRPTLADEELTYLRKLARLLPTHFALGRNTRLQGLAAAILKLWEKSLIAKIAVK

SEQ ID NO: 1105 - protein, 76 aa, Zea mays
LVVVSAMSKVTDMMYNLVNKAQSRDDSYIAVLDEVFDKHMTTAKDLLAGEDLARFLSQLHADISNLKAMLRAIYIA

SEQ ID NO: 1106 - protein, 101 aa, Solanum lycopersicum
IRFDVFLNVDNNVNANELDKAEFAGSYTSLPHVHRVGDPKHTATATLRLAITELLEDIGLEDEDTIAVTLVPKKGDISIGGVEIKLAIVKLVCVVNLLTLQ

SEQ ID NO: 1107 - protein, 176 aa, Solanum lycopersicum
ILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVA

SEQ ID NO: 1108 - protein, 76 aa, Solanum lycopersicum
DENTICVAAILGSTLTGEFEDVKLLNELLTKKNKETGWETPIHVDAASGGFIAPFLWPDLEWDFRLPLVKSINVSG

SEQ ID NO: 1109 - protein, 76 aa, Oryza sativa
MEKPCTLLVHFDKGSPSMANEIKADLEGSDVAAKVDAMKRAIMLLLNGETLPHLFITVVRYVLPSEDHTIQKLLLL

SEQ ID NO: 1110 - protein, 101 aa, Oryza sativa
LQFKDLDKEKKKIQVQVTRNGFRQRLSIYDLLPGDVVHLAIGDQVPADGLFISGFSLLINESSLTGESEPVVVNEDNPFLLSGTKVQDGSCKMLITTVGMR

SEQ ID NO: 1111 - protein, 76 aa, Zea mays
LPDSEGAIDGHLREVGLTFHLLKDVPGLISKNIGRALDDAFKPLGISDWNSIFWVAHPGGPAILDQVEAKVGLDKA

SEQ ID NO: 1112 - protein, 76 aa, Solanum lycopersicum
EFAGSYTSLPHVHRVGDPKHTATATLRLAITELLEDIGLEDEDTIAVTLVPKKGDISIGGVEIKLAIVKLVCVVNL

SEQ ID NO: 1113 - protein, 201 aa, Solanum lycopersicum
LSNMDEPLGHTLKRTEIADGFILEKSSSPLGVVLIIFESRPDALVQIASLAVRSGNGLMLKGGKEAKRSNAILHKVITSAIPVSVGERLIGLVTSREEIPELLKLDDVIDLVIPRGSNKLVSQIKASTKIPVLGHADGICHVYVDKSADMDMAKRITVDAKIDYPAACNAMETLLVHKDLAQNGGLNDLIVELQTKGVSLY

SEQ ID NO: 1114 - protein, 76 aa, Solanum lycopersicum
LILSLDIYVPRDERFGHLKMSDFLTYALKSIVQFILPELHALFDGTPNEFDSFEDVLRLYEGGIKLPQGPLFKALT

SEQ ID NO: 1115 - protein, 76 aa, Oryza sativa
SVPIGPDVVALKGTQQTLKCTQKGLILCVDYSVMPFRKAGPVLDLVQKSVRYLDYRTTLNKHQLDTLKNELKGQRV

SEQ ID NO: 1116 - protein, 201 aa, Solanum lycopersicum
MPLVVRFPDVLKNRLETLQSAFDMAINSQGYEAHYQGVYPVKCNQDRFVVEDIVKFGSPYRFGLEAGSKPELLLAMNCLSKGSADALLVCNGFKDTEYISLALVARKLLLNSVIVLEQEEELDLVIDISRKMSVRPVIGLRAKLRTKHSGHFGSTSGEKGKFGLTTTQILRVVKKLDESGMLDCLQLLHFHIGSQIPTTEL

SEQ ID NO: 1117 - protein, 76 aa, Oryza sativa
NQEPPNLHNLNAFDIISLSTGFDLSGLFGERYGRRESLFTSRKPAAAVLVKLKELAKALNLKVTKTDNGVLKLATT

SEQ ID NO: 1118 - protein, 76 aa, Oryza sativa
MEKPSTLLVHFDKGSAAMAGEIKADLEGSDVAAKVDAMKRAVMLLLNGETLPTLFITVVRYVLPSEDHTIQKLLLL

SEQ ID NO: 1119 - protein, 76 aa, Oryza sativa
GMVLNGKAVCCMHMGSFDEAETLLLEALNKDAKDPETLANLIVCNLHLGKPSSRYLSQLKLSHPDHVLVKRAVSAE

SEQ ID NO: 1120 - protein, 76 aa, Zea mays
ELQNSNVNNLTPLLSNERFHRCLIACSADLVLATHKTVIMMFPAVLESTGLTAFDLSKIIENFVRHEETLPRELKR

SEQ ID NO: 1121 - protein, 76 aa, Solanum lycopersicum
LSNMDEPLGHTLKRTEIADGFILEKSSSPLGVVLIIFESRPDALVQIASLAVRSGNGLMLKGGKEAKRSNAILHKV

SEQ ID NO: 1122 - protein, 226 aa, Oryza sativa
VRDNLYDYLSSRLLTHPVVISEFAESVLGVKTEELIRRMVPSIIPKLIVSHQNNDQAVVTLNELASHLNSELVPLIVNSLPKVLSFALFYEDGQHLSSVLQFYHTETGTDSKEIFSAALPTLLDEIICFPGESDQIETDRRMAKISPTIQNIARILTGNDNLPEFLKNDFVRLLNSIDKKMLHSSDVNLQKQALQRIRKLVEMMGPYLSTHAPKIMVLLIFAIDKE

SEQ ID NO: 1123 - protein, 76 aa, Solanum lycopersicum
SDPLPEVERPLFELVSAAQTLLPDSEGAIDGHLREVGLTFHLLKDVPGLISKNIEKSLIEAFQPLGISDWNSIFWI

SEQ ID NO: 1124 - protein, 76 aa, Oryza sativa
MAKRHLLLVTTCLWALSCALLLHASSDGFLRVNLNKKRLDKEDLTAAKLAQQGNRLLKTGSSDSDPVPLVDYLNTQ

SEQ ID NO: 1125 - protein, 126 aa, Solanum lycopersicum
VCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRLEKVYGTEHSHILRVPFGTEKGIVRK

SEQ ID NO: 1126 - protein, 76 aa, Oryza sativa
GENILLDSTTGDCIHVDFSCLFDKGLLLEKPEVVPFRFTQNMVDGLGITGYEGVFVKVCEITLSVLRTHKEALMTV

SEQ ID NO: 1127 - protein, 76 aa, Solanum lycopersicum
QDVNSLGLISARKTAKAVDILKIMSSTYLVALCQAIDLRHLEENLKSVVKNTVSQVAKRTLTMGANGELHPARFSE

SEQ ID NO: 1128 - protein, 76 aa, Oryza sativa
ELAMSTGKLDMAEECLLHAMDLSGLLLLYSSLGDAEGLTKLTSMAKEQGKNNVAFLCFFMLGKLEECLQLLIESNR

SEQ ID NO: 1129 - protein, 76 aa, Oryza sativa; identical to SEQ ID NO: 1128

SEQ ID NO: 1130 - protein, 76 aa, Zea mays
KQKLRFHYGLTERQLLRYVHIAGKAKRSTGQVLLQLLEMRLDNILFRLGMASTIPGARQLVNHRHILVNGRIVDIP

SEQ ID NO: 1131 - protein, 76 aa, Solanum lycopersicum
KQKLRFHYGLTERQLLKYVRIARKAKGSTGQVLLQLLEMRLDNILFRLGMASTIPAARQLVNHRHILVNGHIVDIP

SEQ ID NO: 1132 - protein, 76 aa, Solanum lycopersicum
QNNTFLLPRDILAAADHLIGLKFGMGALDDMNHLKNKRIRSVADLLQDQFGLALVRLENVVRGTICGAIRHKLIPT

SEQ ID NO: 1133 - protein, 76 aa, Solanum lycopersicum
LCGVLIIGEETIVYCSASAFKAIPIRPSITRAYGRVDADGSRYLLGDHNGLLHLLVITHEKEKVTGLKIELLGETS

SEQ ID NO: 1134 - protein, 76 aa, Solanum lycopersicum
HEMRTPMHAVVALSSLLQESELIPEQRLMVETILKSSNLLATLINDVLDLSRLEDGSLQLDVGTFNLHALFREVLN

SEQ ID NO: 1135 - protein, 76 aa, Zea mays
LQNSNVNNLTPLLSNERFHRCLIACSADVVLATHKTVIMMFPAVLESAGLTSFDLSKIIENFVRHEETLPRELKRH

SEQ ID NO: 1136 - protein, 76 aa, Solanum lycopersicum
QSVSKQKSRFQVVFDRLRINQYSIDWSEVIDKKDLSKSLRFFLSKSLLFLSKLLLFLSNSLPFFCVSFGNIPIHRS

SEQ ID NO: 1137 - protein, 76 aa, Oryza sativa
VEDLVLISDRAYTKGQILEMEKLILNTLQFNMSVPTPYVFMRRFLKAAQSDKQLQLLSFFILELSLVEYQMLKYRP

SEQ ID NO: 1138 - protein, 76 aa, Zea mays
LLDWEGRFNIALGVAKGLAYLHHECLEWVIHCDVKPENILLDQAFEPKITDFGLVKLLNRGGSTQNVSHVRGTLGY

SEQ ID NO: 1139 - protein, 76 aa, Oryza sativa
VKPVLPLVIAKPGCVESALRTLHDDVMDILRPQGRKLDLLIVILPNNNGSLYGDVKRICETDIGLISQCCLAKHVL

SEQ ID NO: 1140 - protein, 76 aa, Oryza sativa
LPDNNGSLYGDLKRICETDLGLVSQCCLTKHVFKMSKQYLANVALKINVKVGGRNTVLVDALTRRIPLVSDRPTII

SEQ ID NO: 1141 - protein, 76 aa, Zea mays
ELHLSFLRLQGQANDFKIQYSSIVRLFLLPKSNNPHTFVVITLDPPIRKGQTLYPHIVIQFETEAVVERDLALSKE

SEQ ID NO: 1142 - protein, 76 aa, Oryza sativa
SGSTPGNEHDIVKNSAPTLQILVKVLDFQIVPLTMKLKSSAEDIVALALSKHRVSLHDVYVYHGRRVIAKSLTLES

SEQ ID NO: 1143 - protein, 101 aa, Solanum lycopersicum
PVLISRLQEFPPKSKLDPTIYGNQNSTITTEHVQDKLNGLTVNEAIKSNRLFILNHHDIVMPLLRKINMSANTKAYASRTLLFLQDDRTLKPLAIELSLPH

SEQ ID NO: 1144 - protein, 76 aa, Oryza sativa
EVTTLFHLDRQMYLLGYLANQSRVYLIDKQFNVVGYTLLLTMIEYKTLVMRGDFDRANALLPSIPKEQHDSVARFL

SEQ ID NO: 1145 - protein, 76 aa, Oryza sativa; identical to SEQ ID NO: 1144

SEQ ID NO: 1146 - protein, 76 aa, Oryza sativa
DMTLLLLAFCAAVSVAIGLATEGWPSGMYDGVGIMLTILLVVMITAASDYKQSLQFRDLDKEKKKIDVQVTRDGYR

SEQ ID NO: 1147 - protein, 76 aa, Oryza sativa
LIYMERYLQQPHVYMTSLSVHRLLITSVVVAAKFTDDAFFNNAFYARVGGISTVEMNRLELDLLFNLDFRLKVDLE

SEQ ID NO: 1148 - protein, 101 aa, Solanum lycopersicum
HPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKG

SEQ ID NO: 1149 - protein, 76 aa, Zea mays
MPGKMVQCLKSVGTANPLVLIDEIDKLGKGHSGDPASALLELLDPEQNVNFLDHYLDVPIDLSKVLFVCTANVIEM

SEQ ID NO: 1150 - protein, 76 aa, Oryza sativa
KGPNPRPLPTNVIKSFLYQLCKGVAHCHGHGVLHRDLKPQNLLVDKEKGILKIADLGLGRAFTVPMKSYTHEIVTL

SEQ ID NO: 1151 - protein, 76 aa, Solanum lycopersicum
MSLGGIVDAILGKDDRPKVKGRVILMKKNVLDFINIGASVVDGISDLLGQKVSIQLISGSVNYDGLEGKLSNPAYL

SEQ ID NO: 1152 - protein, 101 aa, Oryza sativa
DNILSNLHLAFGAYGTEHAIRARKVEEYLTGKILSASVVLEAIRLLRETIVPVEGTTHPEYRVSVAVGFLFSFLSPLCKGVIEPGKTLSISEDLVHTDNVH

SEQ ID NO: 1153 - protein, 76 aa, Solanum lycopersicum
PIIDELFTGIDGKGAFLNGKPIKVSSQSELVKALLATEAGTNRDKLVVDATTGRINSLLFKVRSLRMCGSCALNLC

SEQ ID NO: 1154 - protein, 101 aa, Oryza sativa
LEHLNVTKDISDYLWYTTRVNISDADVAFWSSKGVLPSLTIDKIRDVARVFVNGKLAGSQVGHWVSLKQPIQLVEGLNELTLLSEIVGLQNYGAFLEKDGA

SEQ ID NO: 1155 - protein, 76 aa, Zea mays
GSSMVVYFHNLSQFDGIMILSFLTKSYKNCHIEPIMRNDCIYSIKLYKVSKNGDKRLVLTFMDSYLLLKVKLADLA

SEQ ID NO: 1156 - protein, 76 aa, Zea mays
EDMESDPAAAREKELELERVQSWREQVTLRGVVAALLIGFMYSVIVMKIALTTGLVPTLNVSAALMAFLALRGWTR

SEQ ID NO: 1157 - protein, 101 aa, Oryza sativa
LYTLVLGTISLPINLPGTNYYQGFKARKKLVAMLEQMIAERRSSGQVHDDMLDALLTGVEGTREKLTDEQIIDLIITLIYSGYETMSTTSMMAVKYLSDHP

SEQ ID NO: 1158 - protein, 76 aa, Oryza sativa
ARFHDAMNILGPQHKELDLLIGLLPDNNGSLYGDLKRICEIDLGLVSQCCCTKQVFKMNKQILANLALKINVKVGG

SEQ ID NO: 1159 - protein, 101 aa, Zea mays
LSELASKGVLSCASQEVRDLYNLLEHRFLPLDLASKVQPLLLKISKIGGKLSSASSVPEVKLSQYISALEKLTTLRVLQQASCIFKSIKIDMLSRMIPFFD

SEQ ID NO: 1160 - protein, 76 aa, Oryza sativa
FVLLAVLFIILKVAAHFVPIVVSHLKTFLVVRVQNLNLGIRRGSSQLLERALNVLDVKRLCSKLRLSNKTRDLRKG

SEQ ID NO: 1161 - protein, 76 aa, Oryza sativa
FVLTNERFLVPEMLFHPIDLGMNQAGLAECIVRAIQACHPHLQPVLFERIILTGGSTLFPRFTERLEKELRPLVPD

SEQ ID NO: 1162 - protein, 126 aa, Oryza sativa
TVDGAFDGCVEFREVLAAEELDADADVHPDDVVALPYSSGTTGLPKGVMLTHRSLITSVAQQVDGENPNLYFSKDDVILCLLPLFHIYSLNSVLLAGLRAGSTIVIMRKFDLGALVDLVRKHNITI

SEQ ID NO: 1163 - protein, 76 aa, Zea mays
SNLFRLMKKVGADNNLLVKEHTHTFVNKGGTIGELDFRFPVGAPLHGIQAFLRTNQLKVYDKARNAVALALSPVVR

SEQ ID NO: 1164 - protein, 76 aa, Oryza sativa
VLEKQKELILVGETLLLSTIRFDFNIQHPYEPLKLALKKLGIFQMEVKQVAVNLINDAIRTTLVVQFKPHYIAAGS

SEQ ID NO: 1165 - protein, 76 aa, Oryza sativa
KPQGGELDLLIAILPDNNGSLYGDLKRICETDLGLVSQCCLTKHVFKMSKQYLANVALKINVKVGGRNTVLVDALT

SEQ ID NO: 1166 - protein, 76 aa, Oryza sativa
LSSFPDSSLLHVQHLAKSVVFEILVRGLIGLEAGEEMQQLKQQFQEFIVGLMSLPIKLPGTRLYRSLQAKKKMARL

SEQ ID NO: 1167 - protein, 76 aa, Zea mays
ITFSEAPVFVDPHGRGLRALSRAQIDSVLDLARCTIVSELSNKDFDSYVLSESSLFIYPLKIVIKTCGTTKLLLTI

SEQ ID NO: 1168 - protein, 101 aa, Oryza sativa
RGGGLELVGRRLSHIASLCKVPFEFHPLAISGSKVEAAHLGVIPGEALAVNFTLELHHIPDESVSTANHRDRLLRMVKSLSPKVLTLVEMESNTNTAPFPQ

SEQ ID NO: 1169 - protein, 126 aa, Oryza sativa
VRDNLYDYLSSRLLTHPVVISEFAESVLGVKTEELIRRMVPSIIPKLIVSHQNNDQAVVTLNELASHLNSELVPLIVNSLPKVLSFALFYEDGQHLSSVLQFYHTETGTDSKEIFSAALPTLLDEI

SEQ ID NO: 1170 - protein, 76 aa, Solanum lycopersicum
EMLRALPSLVDIVVPEGKHFTVCGDVHGQFYDLLNIFELNGLPSEDNPYLFNGDFVDRGSFSLEVILTLFAFKCMC

SEQ ID NO: 1171 - protein, 101 aa, Solanum lycopersicum
GNHIEMGLHVFFGCYNNLFRLLKKVGAEKNLLVKEHTHTFVNKGGEIGELDFRFPVGAPLHGINAFLSTNQLKIYDKARNAVALALSPVVRALVDPDGALQ

SEQ ID NO: 1172 - protein, 101 aa, Solanum lycopersicum
LIHSNDEEVLTDACWALSYLSDGTNDKIQAVIEAGVCSRLVELLLHSSPSVLIPALRTVGNIVTGDDIQTQVMIDHHALPCLVNLLTQNYKKSIKKEACWT

SEQ ID NO: 1173 - protein, 101 aa, Zea mays
MTKDETLLVFTLVVSSVSIFLFGILLFMVLISATRDFRERTKSKLVKIMIWAGIVVITFAIAVRIYPIFIFLLKERIKPLVEALYDKLPWIWEVSLSRYWD

SEQ ID NO: 1174 - protein, 126 aa, Zea mays
LVQALFMDGRASDAYVVLEEMQNNGPFPDVFTYTLKVLKNGQWAEEESTILVPGDIIGVKLGDIISADTRLLEGDPLKIDQSALTGNFCICSIVAGMLVEFIVMYPIQDMVYRPRIDKLLVLLIGG

SEQ ID NO: 1175 - protein, 76 aa, Solanum lycopersicum
KIIEAASKLVPLGFTSASQLHAQRLEIIQITSGSKELDKILEGGIETGSITEIYGEFRCGKTQLCHTLCVTCQLPL

SEQ ID NO: 1176 - protein, 76 aa, Oryza sativa
TGICCATLRHKGTVVVMDRFDLRTFLRALVDHRVMFAPLVPPVMLAMVKSPVADEFDLSDLALKSVMTAAAPLAPD

SEQ ID NO: 1177 - protein, 76 aa, Oryza sativa
VSYVNSAFLGHVSLDKSSGDNILSNLHLAFGAYGTKHAIRARKVEEYLTGKILSASVVLEAIRLLRETIVPVEGTT

SEQ ID NO: 1178 - protein, 76 aa, Zea mays
ALKLYYRVLESMCRAESQILSGNNLTSLLSNERFHRCMIACSAELVLATHKTVTMMFPAVLEKTGITAFDLSKVIE

SEQ ID NO: 1179 - protein, 101 aa, Oryza sativa
SDGTGMSGGTSRVKFMDKIKSAFTEAEDPQILLTLLESTAAIVKASDIHGEVFFCSFVLLIGQLGNHDYIVRVTALRLLQRCCTYCFKGGLELFLSKYFHV

SEQ ID NO: 1180 - protein, 76 aa, Zea mays
NLMTTSADEGQFLNMLIKLIGAKKTMEIGVYTGYSLLATALALPEDGTILAMDINRENYELGLPCINKAGVGHKID

SEQ ID NO: 1181 - protein, 201 aa, Oryza sativa
SDGTGMSGGTSRVKFMDKIKSAFTEAEDPQILLTLLESTAAIVKASDIHGEVFFCSFVLLIGQLGNHDYIVRVTALRLLQRCCTYCFKGGLELFLSKYFHVRDNLYDYLSSRLLTHPVVISEFAESVLGVKTEELIRRMVPSIIPKLIVSHQNNDQAVVTLNELASHLNSELVPLIVNSLPKVLSFALFYEDGQHLSSVLQ

SEQ ID NO: 1182 - protein, 76 aa, Solanum lycopersicum
LDIGTFNLHALFREVHSLIKPIASVKKLFVTLSLSSDLPEYVIGDEKRLMQILLNVVGNAVKFSKEGNVSISAFVA

SEQ ID NO: 1183 - protein, 76 aa, Oryza sativa
VTLLPIPLFHVFGFMMVLRSVSMGETSVLMERFDFIAALRAIERYRVTLLPAAPPVLVAMVKYEEARRRDLSSLLV

SEQ ID NO: 1184 - protein, 76 aa, Solanum lycopersicum
KPLWRLVLEQFDDTLVKILLGAAFISFVLAYVNQDETGESGFEAYVEPLVILWILVLNAIVGVWQESNAEKALEAL

SEQ ID NO: 1185 - protein, 126 aa, Solanum lycopersicum
  MOD_RES (84)..(84): Any amino acid
MAQISSMAQGIQTLSLNSSNLSKTQKGPLVSNSLFFGSKKLTQISAKSLGVFKKDSVLRVVRKSSFRISASVATAEKPHEIVLXPIKDISGTVKLPGSKSLSNRILLLAALSEGRTVVDNLLSSDD

SEQ ID NO: 1186 - protein, 76 aa, Oryza sativa
VRTRSLCQLLRLNRTAFLSIVQSNVGDGTIIMNNLIQFLKEQKENSVMAGVVKEIESMLARGNLDLPITLCFAVTR

SEQ ID NO: 1187 - protein, 76 aa, Oryza sativa
TQMGLQLNIDVSSSVFIKPVPVVDYVAQLLNEDILLDRPLCSTEFLKIKEALEGLKVQINGILFNTYHVQDLVHQA

SEQ ID NO: 1188 - protein, 76 aa, Solanum lycopersicum
KSHNLRSIHSTFPFLEDNFSHLNYVLDILIPYPVHLEILVQTLRYWVKDASSLHLLRFFLHEYCNLNSLITSKKPG

SEQ ID NO: 1189 - protein, 76 aa, Zea mays
HSEKVPENLIPHKTFKGNRPSLSLLLPTLSAYEVGQLLSIYEHRIAVQGFIWGINSFDQWGVELGKSLASQVRKQL

SEQ ID NO: 1190 - protein, 76 aa, Zea mays
RYPPGDPSKRAFAYFVLSGGRFIYASLLRLLVLKFVLSMSASKDVLALASLEVDLSSIEPGTTVTVKWRGKPVFIR

SEQ ID NO: 1191 - protein, 151 aa, Solanum lycopersicum
MVCPNSNPVVEKVCELYEQISRLENLSPSKDVNVLFTDLVHTCMPPNPIDVSKLCQKIQEIRSHLIKLCGQAEGLLESHFSKILSSYENPLQHLHIFPYFDNYIKLSLLEYNILTKNTTNIPKKIAFIGSGPLPLTSLVLATKHLKTTCFH

SEQ ID NO: 1192 - protein, 76 aa, Solanum lycopersicum
GLILTNPSNPLGTTLDKDTLKSVLSFTNQHNIHLVCDEIYAATVFDTPQFVSIAEILDEQEMTYCNKDLVHIVYSL

SEQ ID NO: 1193 - protein, 101 aa, Solanum lycopersicum
PSESHLDSLVGQALFGDGAAAIIIGSDPIIGVERPLFELVSAAQTLVPDSEGAIDGHLREVGLTFHLLKDVPGLISKNIEKSLLEAFQPLGISDWNSLFWI

SEQ ID NO: 1194 - protein, 76 aa, Oryza sativa
RKIAEMDVTSRELAPAITVLQLFLSSSKPVLRFAAVRTLNKVAMTRPLAVTNCNVDLESLMSDQNRSIATLAITTL

SEQ ID NO: 1195 - protein, 76 aa, Solanum lycopersicum
DNYIKLSLLEYNILTKNTTNIPKKIAFIGSGPLPLTSLVLATKHLKTTCFHNYDIDVDANFMASALVAADPDMSSR

SEQ ID NO: 1196 - protein, 76 aa, Oryza sativa
ADFGVHNDAAAFGFLCQGLLGRDPAKSALGRDGPKLITKWVLFQLSPLLSLGLPTLVEDTLLHSLRLPPALVKKDY

SEQ ID NO: 1197 - protein, 101 aa, Zea mays
RLHNRISMLQVVSELDHAADQDSTFGIPSQVVVYDAAALADFGLLAALRFPLIAKPLVADGTAKSHKMSLVYHREGLGKLRPPLVLQEFVNHGGVIFKVYV

SEQ ID NO: 1198 - protein, 76 aa, Zea mays
EYTSEIFMGGKNTIVLHNTCEDSLLAAPIILDLVLLAELSTRIQLKAEGEDKFHSFHPVATILSYLTKAPLVPPGT

SEQ ID NO: 1199 - protein, 76 aa, Oryza sativa
GFKCIPLEQHIRSLGDSLFEIIWIPPDLRVSGFCSYLIILGKPARKIICQLLKLLEIIHAANRFASRFTIADLVFL

SEQ ID NO: 1200 - protein, 76 aa, Oryza sativa
QNRGLKNFSLLLSLSTLYAPLLILKYMDLFLKLRSSQDSEEEVPINKRLAYRVDIFLSLQPYAKPLVLLVATLLLI

SEQ ID NO: 1201 - protein, 76 aa, Oryza sativa
MRGAMKPSIVHCLKLLMLLALGGVTMHVPDEDDVVASLGALRLDGHFSFDDAHAAARDFGNRCSLLPAAVLHPGSV

SEQ ID NO: 1202 - protein, 76 aa, Zea mays
FEDFANHNAFDLLEKYSKSHLVFNDDIQGTASVVLAGLLAALKMVGGTLAEQTYLFLGAGEAGTGIAELIALEISK

SEQ ID NO: 1203 - protein, 76 aa, Zea mays
VVPFLNSMRLLIYGLRLYTDEALVKSVTREGKPEELLRGPLYYVLVLLFSVLVFWRESPIGIVSLSMMSGGDGFAD

SEQ ID NO: 1204 - protein, 126 aa, Zea mays
SIFGELHTQIKNKKLTVDVKANSESDLLTTITVDEFGTPGLKSIINLVVPDQRSGKLEFQYLHEYAGVNASVGLNSNPMVNLSGAFGSKALSVGVDVSFDTATSDFTKYNAALSLTSPDLIASLHL

SEQ ID NO: 1205 - protein, 101 aa, Oryza sativa
AARAITELNGVTSRELTPAITVLQLFLSSSKPVLRFAAVRTLNKVASTHPLAVTNCNIDMESLISDQNRSIATLAITTLLKTGNESSVDRLMKQMTNFMSD

SEQ ID NO: 1206 - protein, 226 aa, Solanum lycopersicum
MAQTMLLTANAKVDLRSKESLVERLKPKPLSSLFLPSLPLRFSSSSTNASSSKFTSTTVALFKSKAKAPPKKVAPPKEKQKVEDGIFGTSGGIGFTKQNELFVGRVAMIGFAASLLGEAITGKGILAQLNLETGIPIYEAEPLLLFFILFNLLGAIGALGDRGKFVDDPTPPTGLEKAVIPPGKSFKSALGLSEGGPLFGFTKANELFVGRLAQLGIAFSIIGEII

SEQ ID NO: 1207 - protein, 76 aa, Zea mays
TIYNSEGKKFALHLVPSGILHEGTLCVVGNGAVIHVPGFFGEIDGLESNGVRCGGRILVSDRAHLLFDLHQAVDGL

SEQ ID NO: 1208 - protein, 76 aa, Oryza sativa
LPERKNCDIYGPWKRMCLVKYGIVTQCLAPTKINDQYLTNVLLKINAKLGGLNSLLQIERNQAIPLLSKTPTIILG

SEQ ID NO: 1209 - protein, 76 aa, Oryza sativa
LCYKPPGGNVKRKLAIVGKGLTFDRFYLSLDNLLIVTKFVCIGGYNIKIGAVTTIELMKKDMGGSAALFGAAKALG

SEQ ID NO: 1210 - protein, 76 aa, Oryza sativa
RGDLKVTDFGLSALDGGLRGDGLLHTTCGTPAYVAPEVLLKRGYDGAKADIWSCGVILFVLLAGYLPFNETNLVIL

SEQ ID NO: 1211 - protein, 76 aa, Oryza sativa
SGVGIDDWWRNEQFWVIGGVSSHLFALFQGLLKVIAGIDTSFTVTSKGGDDEEFSELYTFKWTTLLIPPTTLLLLN

SEQ ID NO: 1212 - protein, 126 aa, Solanum lycopersicum
LIFVTRSRSWSFVERPGLLLVFAFFVAQLVATLIAVYANWSFAAIEGIGWGWAGVIWLYNIVTYIPLDLIKFLIRYALSGKAWDLVLEQRIAFTRKKDFGKELRELQWAHAQRTLHGLQVPDPKIF

SEQ ID NO: 1213 - protein, 101 aa, Oryza sativa
SDPKRKPRYLSKILMVALLTAMCVVMLTQPPCHRRTPSVFSIHEPGVTHVLVTGGAGYIGSHAALRLLKDSFRVTIVDNLSRGNMGAIKVLQNLFSEPGRL

SEQ ID NO: 1214 - protein, 76 aa, Solanum lycopersicum
LCKTVVELDLSYNNFSGMVPESLGECSSLELVDISYNNFSGKLPVDTLSKLSNIKTMVLSFNKFVGGLPDSFSNLL

SEQ ID NO: 1215 - protein, 76 aa, Zea mays
MIIDRVEVETINSFSKLELFKEIYGLIWILPIFALLLGITIEVLVIVWLEREISASIQQRIGPEYAGPLGLLQAIA

SEQ ID NO: 1216 - protein, 76 aa, Solanum lycopersicum
PAPALSNGFVTFGSFNNLAKITPKVLKVWARILSAVPHSRLIVKCKPFCCDSVRQRFLSILEQLGLEPQRVDLLPL

SEQ ID NO: 1217 - protein, 76 aa, Oryza sativa
CHVNNVLHRDIKGANLLISGGGKLLKLADFGLARPFTRDGSFTNHVITLWYRPPELLLGATNYAEAVDIWSVGCIF

SEQ ID NO: 1218 - protein, 76 aa, Zea mays
ELIRKLQPQVVVTGMAQFEAITSAAFENLLNVTKDVGSRLFLDISEHLELSSLPSSNGVLKYLAGKTLPSHAAILC

SEQ ID NO: 1219 - protein, 76 aa, Oryza sativa
MSELLFETYGVPSIGNDTYLFVPLLSIVHGSFEVRIVDAKDVSSYFLKGEPVLGACCRTNVGGFHITDFLRQLLSL

SEQ ID NO: 1220 - protein, 76 aa, Solanum lycopersicum
HGEPGAAVADLQPVDVVVSHVLKEILSPETNYVPITRGSRVVLLINGLGATPLMELMIIAGKAVPELQLEHGLAVD

SEQ ID NO: 1221 - protein, 76 aa, Zea mays
EDHLHIILHFSTNIICLAILSGSFFLGKEELVILNSWVQEFFYNLNDSIKAFFILLVTDFFVGFHSTRGWELLIRW

SEQ ID NO: 1222 - protein, 76 aa, Solanum lycopersicum
SCGENSFHFPSHGKPFSLRLALSPSRGILVIGSIGTGRSYLVKYLATNSYVPFITVFLNKFLDNKSKGFLLDEIDI

SEQ ID NO: 1223 - protein, 76 aa, Solanum lycopersicum
SLGTNCPPVRIVSKGGLPGGKVKLSGSISSQYLTALLMAAPLALGDVEIEIIDKLISVPYVEMTLKLMERFGVFVE

SEQ ID NO: 1224 - protein, 76 aa, Zea mays
RIGYSMITDAEEKGLITPGVSVLIEPTSGNTGIGLAFMAAAKGYKLTLTMPASMSMERRIILKAFGAELVLTDPLL

SEQ ID NO: 1225 - protein, 101 aa, Solanum lycopersicum
ESFFTQLYSVTLASSGELICKDFFLYMESNQFGLFATSTAQIHDAPPTGGAIQGVPSVEKITFHLLRLVDGAILDERVFHNDYVNLAHSIGAFLYDDLLAI

SEQ ID NO: 1226 - protein, 76 aa, Solanum lycopersicum
TAIFIVKLGIPGRLNESKLPFTAGLPANHMQMTFQGLKVLVMDDNGFSRMVTKSLLVHLGCDVTTIGSGDECLRIL

SEQ ID NO: 1227 - protein, 101 aa, Oryza sativa
LLMLAVLCHSLPLMLRYAVTSGDHAIVSGDAALHLSRACSILMLIAYLAYLFFQLNTHRQLFEPQQVEDDDDDDLVIAQDDEPVLGFSSAMIWLALMTLLT

SEQ ID NO: 1228 - protein, 76 aa, Oryza sativa
TAVGMRTQWGKLMAVLTDGGDDETPLQTRLNGVANTIGKIGLFFAVLTFIVLSQGIIGQKYLDGLLLSWSGDDVLE

SEQ ID NO: 1229 - protein, 76 aa, Oryza sativa
MEASVLKYLKFEMTAPTTKCFLRRFLRAAQVCHEAPVLHLEFLANYIAELSLLEYSLICYVPSLIAASSIFLAKFI

SEQ ID NO: 1230 - protein, 76 aa, Zea mays
WFHYHKAAPKLAWFQDVESMLNHHLAGLLGLGSLSWAGHQIHVSLPINQFLDAGVDPKEIPLPHEFILNRDLLAQL

SEQ ID NO: 1231 - protein, 101 aa, Oryza sativa
NAPGKHLGVVGLGGLGHLGVKFGKAFGMKVTVISSSPAKREEALERLGADAFLSSRDGEGMAAAAATMDGIIDTVSAGHPLVPLLSLLKPKGQMVVVGAPA

SEQ ID NO: 1232 - protein, 76 aa, Solanum lycopersicum
IDNLLVLLIGGIPIAMPTVLSVTMAIGSHRLAQQGAITKRMTAIEEMAGMDVLCSDKTGTLTLNKLTVDKNLVEVF

SEQ ID NO: 1233 - protein, 201 aa, Oryza sativa
LPPLAAPLVLVPDTFQQQHDDDQFDFFFHALLETDPETPVEMGVGVGQDDAAAVLYSSGTSGRSKGVVVTHRNLIAMVELFVRFEASQYTRPARDNVYLAALPMFHVYGLSLFAVGLLSLGCTVVVMRRFNVDDAVKAIRKYKVTHLPLVPPIMSALLRANPPLELDSLLQVSSGAAPLNHTLIHHFLHAFPHVDFIQGYG

SEQ ID NO: 1234 - protein, 76 aa, Solanum lycopersicum
PGIDNLLVLLIGGIPIAMPTVLSVTMAIGSHRLAQQGAITKRMTAIEEMAGMDVLCSDKTGTLTLNKLTVDKALIE

SEQ ID NO: 1235 - protein, 101 aa, Oryza sativa
KELDSLVNVYTAVTGQEPIAYLGPRKWSAARTGSTQHVKLWKSSIIEALKSEPYLAFSILFICLKILVAFFPKFFSCIKGIWVQYFRHANLGILAKLTQLL

SEQ ID NO: 1236 - protein, 101 aa, Oryza sativa
GMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVE

SEQ ID NO: 1237 - protein, 101 aa, Oryza sativa
ANDAVALPYSSGTTGLPKGVMLSHRGLVTSVAQLVDGENPNLHLREDDVVLCVLPMFHVYSLHSILLCGMRAGAAIVVMKRFDTVKMLQLVERHGVTIAPL

SEQ ID NO: 1238 - protein, 76 aa, Zea mays
NLQDTVLELEFQGIKKKFTMLQTWPVRSPRPVASKLAADTPLLTGQRVLDALFPSVLGGTCAIPGAFGCGKTVISQ

SEQ ID NO: 1239 - protein, 76 aa, Solanum lycopersicum
YILHPRGAIIGDTIVSGTEVPIKMGNALPLTDMPLGTAIHNIEITLGKGGQLARAAGAVAKLIAKEGKSATLKLPS

SEQ ID NO: 1240 - protein, 176 aa, Zea mays
VVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTI

SEQ ID NO: 1241 - protein, 101 aa, Oryza sativa
RTIEILNQESESTSSPNGSVVFRKLAEHMSKVASPFVRNTASIGGNIILAHKYPFRSDIATILLGAAATVNLQVSSKTLHVTLEQFLEQPPLGHNTLLLSI

SEQ ID NO: 1242 - protein, 76 aa, Zea mays
LKPKYVLMENVVDILKFADGYLGKYALSCLVAMKYQARLGMMVAGCYGLPQFRMRVFLWGALSSMVLPKYPLPTYD

SEQ ID NO: 1243 - protein, 76 aa, Oryza sativa
EGHLHIILHFSTNIICLAILSGSFFLGKEELVILNSWVQEFFYNLNDSVKAFFILLVTDFFVGFHSTRGWELLIRW

SEQ ID NO: 1244 - protein, 101 aa, Solanum lycopersicum
YASRTLLFLQDNGSLKPLAIELSLPHPDGDQFGVTSKVYTPSDQGVEGSIWQLAKAYVAVNDSGVHQLISHWLNTHAVIEPFVIATNRQLSVLHPIHKLLY

SEQ ID NO: 1245 - protein, 151 aa, Solanum lycopersicum
FQFMGGSMGSVVGEKITRLIEHAANQNLPLMIVCASGGARMQEGSLSLMQMAKISSALYDYQLNKKLFYVSILTSPTTGGVTASFGMLGDIIIAEPNAYIAFAGKRVIEQTLNKTVPEGSQAAEYLFQKGLFDLIVPRNLLKSVLSELFKL

SEQ ID NO: 1246 - protein, 76 aa, Solanum lycopersicum
MAAKNSEMKFAIFFVVLLTTTLVDMSGISKMQVMALRDIPPQETLLKMKLLPTNILGLCNEPCSSNSDCIGITLCQ

SEQ ID NO: 1247 - protein, 76 aa, Oryza sativa
TTGLPKGVMLTHRSLVTSVAQQVDGENPNLYFRREDVVLCLLPLFHIYSLNSVLLAGLRAGSAIVIMRKFDLGALV

SEQ ID NO: 1248 - protein, 76 aa, Solanum lycopersicum
FHYHKAAPKLAWFQDVESMLNHHLAGLLGLGSLSWAGHQVHVSLPINQFLNAGVDPKEIPLPHEFILNRDLLAQLY

SEQ ID NO: 1249 - protein, 76 aa, Zea mays
ADAYLVSSDAAAMAAAADSLDYIIDTVPVHHPLEPYLALLKLDGKLVLLGVIGEPLSFVSPMVMLGRKAITGSFIG

SEQ ID NO: 1250 - protein, 76 aa, Zea mays
FRGGLDPITGGLWLSDIAHHHLAIAILFLIAGHMYRTNWGIGHGLKDILEAHKGPFTGQGHKGLYEILTTSWHAQL

SEQ ID NO: 1251 - protein, 76 aa, Zea mays
MILRLLECRFFTIALCDAAEPWQLGFQDAATPMMQGIIDLHHDIFFFLILILVFVLWMLVRALWHFNEQTNPIPQR

SEQ ID NO: 1252 - protein, 76 aa, Solanum lycopersicum
MIIDTTEIETINSFSKLESLKEVYGIIWMLVPIVTLVLGITIGVLVIVWLEREISAGIQQRIGPEYAGPLGILQAL

SEQ ID NO: 1253 - protein, 76 aa, Zea mays
MLEFAPICIYLVISLLVSLILLGVPFLFASNSSTYPEKLSAYECGFDPFGDARSRFDIRFYLVSILFIIFDLEVTF

SEQ ID NO: 1254 - protein, 76 aa, Zea mays
MAKLMNKLVDSFEHDEIPDVGCVRAVLAELVLTFLFVFTGVSAAMAAGSDGKPGDAMPMATLAAVAIAHALAAGVL

SEQ ID NO: 1255 - protein, 101 aa, Oryza sativa
VALVINFVSACIIGSAPLTAVQLLWVNMIMDTLGALALATEPPNDEMMKRPPVRKGESFITKFMWRNIMGQSLYQLFVLGALMFGGERLLNIKGADSKSII

SEQ ID NO: 1256 - protein, 76 aa, Solanum lycopersicum
MTQIMFETFNTPAMYVAIQAVLSLYASGRSTGIVLDSGDGLSHTVPIYEGYALPHAILRLDLAGRDLTDSLMKILT

SEQ ID NO: 1257 - protein, 76 aa, Solanum lycopersicum
MTQIMFETFNVPAMYVAIQAVLSLYASGRTTGIVLDSGDGVSHTVPIYEGYALPHAILRLDLAGRDLTDNLMKILT

SEQ ID NO: 1258 - protein, 76 aa, Oryza sativa
MAAATVGVLLRLLLLPVVVVVSLLVGASRAANVTYDHRAVVIDGVRRVLVSGSIHYPRSTPDMWPGLIQKSKDGGL

SEQ ID NO: 1259 - protein, 101 aa, Oryza sativa
NVGKVIAALVLTTLCIFILKQSPGFGGSSVFSRHEPGVTHVLVTGGAGYIGSHASLRLLKDNYRVTIVDNLSRGNMGAVKVLQELFPQPGRLQFIYADLGD

SEQ ID NO: 1260 - protein, 176 aa, Oryza sativa
SLIGLVPLAERLSFLTEQIAFYTGPTVGGLLNATFGNVTEVIIALLALREGKIEVVKCSLLGSILSNLLLVLGTSLFLAGIANLRAHQPYDTKQAHVNTALLMLAVLCHSLPLMLRYAVTSGDHAIVSGDAALHLSRACSILMLIAYLAYLFFQLNTHRQLFEPQQVEDDDDDDLV

SEQ ID NO: 1261 - protein, 101 aa, Oryza sativa
NGPGKHLGVVGLGGLGHLGVKFGKAFGMKVTVISSSPAKRGEALGRLGADAFLSSRDGEGMAAAAATMDGIIDTVSAGHPLVPLLSLLKPKGQMVVVGAPA

SEQ ID NO: 1262 - protein, 126 aa, Oryza sativa
DNFETIVNVARWGRAVYLNIQKFVQFQLTVNIVALIVNFVSACIIGSAPLTAVQLLWVNMIMDTLGALALATEPPNDEMMKRPPVRRGDNFITRIMWRNILGQGLYQLLVLATLMVIGKKLLSIEG

SEQ ID NO: 1263 - protein, 76 aa, Zea mays
MAAAARVSEVKAEGLLRGACTALAAAAALLVGLSTQTETVLLVRKKATVKDVQALWVLAMAAAAAAGYHLLQLLKC

SEQ ID NO: 1264 - protein, 76 aa, Oryza sativa
LGQGLYQLLVLATLMVIGKKLLSIEGPQSDKTINTLIFNSFVFCQVFNEINCREMEKINVLQGIFRNWIFVGILTA

SEQ ID NO: 1265 - protein, 76 aa, Solanum lycopersicum
LFVGRVAMIGFAASLLGEAITGKGILAQLNLETGIPIYEAEPLLLFFILFNLLGAIGALGDRGKFVDDPTPPTGLE

SEQ ID NO: 1266 - protein, 76 aa, Solanum lycopersicum
MANPQQPLLIKTHKQNPIISFKILSFVITLFVALFLVAPYQVEIKHSNLCKTAQDSQLCLSYVSDLISNEIVTTES

SEQ ID NO: 1267 - protein, 76 aa, Zea mays
MAAAARVSEVKAEGLLRGACAALAAAAALLVGLSTQTETVLLVRKKATVKDVQALWVLAMAAAAAAGYHLLQLLKC

SEQ ID NO: 1268 - protein, 76 aa, Solanum lycopersicum
AVKQNYGEKVLIQFEDFANHNAFNLLAKYGTSHLVFNDDIQGTASVVLAGLMAALNLVGGSLSEHTFLFLGAGEAG

SEQ ID NO: 1269 - protein, 76 aa, Oryza sativa
WVIGGVSAHLFAVVQGLLKVLAGIDTNFTVTSKATGDEDDEFAELYAFKWTTLLIPPTTLLILNIIGVVAGVSDAI

SEQ ID NO: 1270 - protein, 76 aa, Zea mays
IVAYLKPKYVLMENVVDILKFADGYLGKYALSCLVAMKYQARLGMMVAGCYGLPQFRMRVFLWGALSSMVLPKYPL

SEQ ID NO: 1271 - protein, 76 aa, Zea mays; identical to SEQ ID NO: 1270

SEQ ID NO: 1272 - protein, 76 aa, Oryza sativa
ADAYLVSSDAAAMAAAGDSLDYIIDTVPVHHPLEPYLALLKLDGKLILMGVINQPLSFISPMVMLGRKAITGSFIG

SEQ ID NO: 1273 - protein, 101 aa, Oryza sativa
VNIVALVINFVSACITGSAPLTAVQLLWVNMIMDTLGALALATEPPNDEMMKRPPVRKGESFITKVMWRNIMGQSLYQLFVLGALMFGGESLLNIKGADSK

SEQ ID NO: 1274 - protein, 76 aa, Oryza sativa
MRPSLLQYLKLLLLLALGGVTTMHVPKQDVPSSLEELTLDGHFSFHDVSAAAQDFGNLSSFPPVAVLHPGSVADIA

SEQ ID NO: 1275 - protein, 276 aa, Zea mays
MIIDRVEVETINSFSKLELFKEIYGLIWILPIFALLLGITIEVLVIVWLEREISASIQQRIGPEYAGPLGLLQAIADGTKLLLKEDILPSRGDIPLFSIGPSIAVISILLSFLVIPLGYRFVLADLSIGVFLWIAISSIAPIGLLMAGYSSNNKYSFLGGLRAAAQSISYEIPLTFCVLAISLLSNSLSTVDIVEAQSKYGFFGWNLWRQPIGFLVFLISSLAECERLPFDLPEAEEELVAGYQTEYSGIKYGLFYLVSYLNLLVSSLFVTVLYLG

SEQ ID NO: 1276 - protein, 76 aa, Oryza sativa
GVNRYAEKPSRSFWMFVWDALQDMTLIILMVCALLSVAVGLATEGWPKGMYDGLGIILSIFLVVMVTAVSDYKQSL

SEQ ID NO: 1277 - protein, 176 aa, Zea mays
MIIDRVEVETINSFSKLELFKEIYGLIWILPIFALLLGITIEVLVIVWLEREISASIQQRIGPEYAGPLGLLQAIADGTKLLLKEDILPSRGDIPLFSIGPSIAVISILLSFLVIPLGYRFVLADLSIGVFLWIAISSIAPIGLLMAGYSSNNKYSFLGGLRAAAQSISYEIPLTF

SEQ ID NO: 1278 - protein, 76 aa, Solanum lycopersicum
FTGLFAKEEFVLQAYNSGKTQIIRPSGLILGGGWGLFGAQIVELLSIVVWVSLTMGPLFYLLQKLGILRISSDEEV

SEQ ID NO: 1279 - protein, 76 aa, Oryza sativa
ALPMFHVYGLSLFAVGLLSLGCTVVVMRRFNVDDAVKAIRKYKVTHLPLVPPIMSALLRANPPLELDSLLQVSSGA

SEQ ID NO: 1280 - protein, 76 aa, Oryza sativa
YPLASLPLTVYCALPAVCLLTGKSTFPSDVSYYDGVLLILLLFSVAASVALELRWSRVPLRAWWRDEKLWMVTATS

SEQ ID NO: 1281 - protein, 76 aa, Zea mays
MMFERVLFLSVYLFSIGIYGLITSRNMVRALICLELILNSINLNLVTFSDLFDSRQLKGDIFAIFVIALAAAEAAI

SEQ ID NO: 1282 - protein, 76 aa, Solanum lycopersicum
MTQIMFETFNVPAMYIAIQAVLSLYASGRTTGIVLDSGDGVTHTVPIYEGYALPHAILRLDLAGRDLTDYLMMILT

SEQ ID NO: 1283 - protein, 226 aa, Zea mays
EDSSIDIGDFFKGPLPGKFLKLLGFLALSRLGVYIPLGGVNREAFAGNLDQNSLLGTLDSFSGGGIGRLGICSLGIVPFINAQIVFQLLAQLYPKLQDLQRKEGEAGRKKVLQYTRYASVGFAIVQAIGQVLYLRPYVNDFSTEWVLTSVTLLTLGSVFTTFIGERISDLKLGNGTSLLIFTSIISYLPASFGRTVAQAFQDGNYVGLLTIILSFLLLVLGIVYVQ

SEQ ID NO: 1284 - protein, 101 aa, Solanum lycopersicum
YGFWGWNLWRQPIGFIVFLISSLAECERLPFDLPEAEEELVAGYQTEYSGIKFGLFYIASYLNLLVSSLFVTVLYLGGWNLSIPYIFVPDIFGINKGGKVF

SEQ ID NO: 1285 - protein, 76 aa, Solanum lycopersicum
NLTLSPSIIFGYLLKSPFGGEGWIVSVDDLEDIIGGHVWLGSICILGGIWHILTKPFAWARRALVWSGEAYLSYSL

SEQ ID NO: 1286 - protein, 201 aa, Oryza sativa
STVMLLLPNSVEFAVAFLASSRLGAVTTTANPLHTPPEIAKQVAASGATVVVTEPAFVAKVSGLAGVTVVATGGGAERCASFAGLAAADGSALPEVAIDVANDAVALPYSSGTTGLPKGVMLSHRGLVTSVAQLVDGENPNLHLREDDVVLCVLPMFHVYSLHSILLCGMRAGAAIVVMKRFDTVKMLQLVERHGVTIAPL

SEQ ID NO: 1287 - protein, 76 aa, Oryza sativa
TVAKWGRSVYVNIQKFVQFQLTVNVVALLVNFSSACFTGNAPLTAVQLLWVNMIMDTLGALALATEPPNDDLMKRE

SEQ ID NO: 1288 - protein, 76 aa, Oryza sativa
LQVHLHDADVTTLPPPPPFLTLGPRIGYLPLLVPIIKAHFSSTLPPGIDTVWFEYKGLPLKWYIPIGVLYDLLCAD

SEQ ID NO: 1289 - protein, 76 aa, Zea mays
NLTLSPGVIFGYLLKSPFGGEGWIVSVDDLEDIIGGHVWLGSICVLGGIWHILTKPFAWARRAFVWSGEAYLSYSL

SEQ ID NO: 1290 - protein, 101 aa, Oryza sativa
KRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFI

SEQ ID NO: 1291 - protein, 76 aa, Solanum lycopersicum
AVSITIRIVLGFMLLALIWKFDFPPFMVLIIAILNDGTIMTISKDRVKPSPLPDSWKLAEIFTTGVVLGGYLAMMT

SEQ ID NO: 1292 - protein, 76 aa, Solanum lycopersicum
IYAVSITIRIVLGFMLLALIWKFDFPPFMVLIIAILNDGTIMTISKDRVKPSPLPDSWKLAEIFTTGVVLGGYLAM

SEQ ID NO: 1293 - protein, 126 aa, Zea mays
RKEGEAGRKKVLQYTRYASVGFAIVQAIGQVLYLRPYVNDFSTEWVLTSVTLLTLGSVFTTFIGERISDLKLGNGTSLLIFTSIISYLPASFGRTVAQAFQDGNYVGLLTIILSFLLLVLGIVYVQ

SEQ ID NO: 1294 - protein, 126 aa, Zea mays
MKGSSEHGETSKQAPLGSSRGVSKGVSVLDLILRFIAIIGTLASAIAMGTTNETLPFFTQFIRFKAQYSDLPTLTFFVVANSIVCAYLTLSLPLSIVHIIRSRAKYSRLLLVVLDAAMLALVTPGA

SEQ ID NO: 1295 - protein, 76 aa, Solanum lycopersicum
MILEHVLVLSAYLFSIGIYGLITSRNMVRALMCLELILNAVNINFVTFSDFFDNRQLKGDIFSIFVIAIAAAEAAI

SEQ ID NO: 1296 - protein, 76 aa, Zea mays
MVAAARVVSGVKAEGLLRGACAALAAAAALLLGLSTQTETVLLVRKKGTVKDVQALWVLAMAAASAAGYHLLQLLK

SEQ ID NO: 1297 - protein, 76 aa, Oryza sativa
LHPPLPLPSDPSLSLVPHLFSHLPLHHHSLLVDAPTAATLSCADFRRLVSSLAAGLRRRLHIARGSLVLLLLPNSL

SEQ ID NO: 1298 - protein, 76 aa, Solanum lycopersicum
QFLILLCSTLCIPLSVEYIECTEMAITEFLLFVLTATLGGMFLCGANDLITIFVAPECFSLCSYLLSGYTKKDVRS

SEQ ID NO: 1299 - protein, 76 aa, Solanum lycopersicum; identical to SEQ ID NO: 1298

SEQ ID NO: 1300 - protein, 76 aa, Zea mays
QFLILLCSTLCIPLSVEYIECTEMAITEFLLFVLTATLGGMFLCGANDLITIFVALECFSLCSYLLSGYTKRDLRS

SEQ ID NO: 1301 - protein, 76 aa, Zea mays; identical to SEQ ID NO: 1300

SEQ ID NO: 1302 - protein, 76 aa, Zea mays
MERNGEIVNNGSIIIPGGGGPVTESPLDQFGIHPILDLNIGKYYVSFTNLSLSMLLTLGLVLLLVFVVTKKGGGKS

SEQ ID NO: 1303 - protein, 76 aa, Zea mays
AVATALIQVAYMGLVGSFPFNSFLSGVLSCIGTAVLAVCLRIQVNKDNKEFKDLPPERAFADFVLCNLVLHLVIMN

SEQ ID NO: 1304 - protein, 76 aa, Solanum lycopersicum
MATPQQPLLTKTHKQNSIISFKILTFVVTLFVALFLVVFLVAPYQFEIKHSNLCKTAQDSQLCLSYVSDLMSNEIV

SEQ ID NO: 1305 - protein, 101 aa, Zea mays
GFFGWNLWRQPIGFLVFLISSLAECERLPFDLPEAEEELVAGYQTEYSGIKYGLFYLVSYLNLLVSSLFVTVLYLGGWNFSIPYISFFGFFQMNKIIGILE

SEQ ID NO: 1306 - protein, 76 aa, Solanum lycopersicum
MATPLQPFLTKTHKQNPIIGFNILTFVVTLFVALFLVVFLVAPYQFEIKHSNLCKTAQDSQLCLSYVSEIVTTESD

SEQ ID NO: 1307 - protein, 76 aa, Solanum lycopersicum
MATPQQPLLTKTHKQNSIISFKILTFVVTLFVALFLVVFLVAPYQFEIKHSNLCKTAQDSQLCLSYVSDLISNEIV

SEQ ID NO: 1308 - protein, 76 aa, Oryza sativa
GAPVVCIDVAAQLCCDFNKNQSTWSPILLLVPLVLGLDKLNPRYIPLLKETLTFPQSLGILGGKPGTSTYIAGVQD

SEQ ID NO: 1309 - protein, 76 aa, Zea mays
VPEWYFLPIHAILRSIPDKAGGVAAIAPVFISLLALPFFKEMYVRSSSFRPIHQGIFWLLLADCLLLGWIGCQPVE

SEQ ID NO: 1310 - protein, 76 aa, Zea mays
MGKLTLGHRGEASEPDFFRGVLGELVLTFLFVFIGVGAAMTDGATTKGSTAGGDLTAVALGQALVVAVIATAGFHI

SEQ ID NO: 1311 - protein, 76 aa, Oryza sativa
SDRLHQVLRWALGSVEIFFSNHCPLWYGYGGGLKCLERFSYINSIVYPFTSIPLLAYCTLPAICLLTGKFITPELT

SEQ ID NO: 1312 - protein, 76 aa, Oryza sativa
IIFTALFARREYVELIYGVPGRPYGLFMGGGGRLLAAHIVQILVIVGWVSATMGTLFYVLHRFGLLRVSPATEMEG

SEQ ID NO: 1313 - protein, 76 aa, Oryza sativa
TLLKALRWRLACVTPFSFLPVTTTTTTTRALLLRSLLDPSFLRFDASLLAASALTLSSTTPQHPNHLLLNRLIHPF

SEQ ID NO: 1314 - protein, 76 aa, Zea mays
MDSTNVYAYISIIALIVCIPPALIFEGPKLMQHGFSDAIAKVGLTKFVSDLFLVGLFYHLYNQIATNTLERVAPLT

SEQ ID NO: 1315 - protein, 76 aa, Oryza sativa
TDGRPTQGGFASAMVVDQKFVVKIPAGLAPEQAAPLLCAGLTVYSPLKHFGLMSPGLRGGVLGLGGVGHMGVKVAK

SEQ ID NO: 1316 - protein, 76 aa, Oryza sativa
ISMVHHVVSVILIALSYIFRFARVGSIVLAIHDASDVFLELGKISKYSGYQLLADVSFLIFVCSWAVLRLIYYPFW

SEQ ID NO: 1317 - protein, 76 aa, Solanum lycopersicum
AGVFGNGIESFHTLPHSATRAAMLVRINTLLQGYSGIRFEILEAITKLINSNITPCLPLRGTITASGDLVPLSYIA

SEQ ID NO: 1318 - protein, 76 aa, Oryza sativa
MAHRRIALAVLVTLLLSAFRPCLAQQSNDDTSKHHRSATAGGFTPTTVVVLVALITAFVLLTVFSVLINRCAQARA

SEQ ID NO: 1319 - protein, 76 aa, Zea mays
VACYTIAFGGGFGSTLLGLDKKTYELAGASPANVPGSYKDPGFGWMAGFVAAISFAGLLSLIPLRKVLVIDYKLTY

SEQ ID NO: 1320 - protein, 76 aa, Oryza sativa
MEVAMVCTRVNLLILILSLCSPYKFIQSPMDFGPLNLLPTTTTASSDFGRILFHSPSAVLKPQAPRDISLLLSFLS

SEQ ID NO: 1321 - protein, 76 aa, Oryza sativa
LYEIDIPLNFVASVGTRVHGLACWFDVLFNGSTVQRWLTTAPGSPTTHWYQLRCILSQPLYVMAGQEITGRLHLVA

SEQ ID NO: 1322 - protein, 126 aa, Oryza sativa
TIINVAKWGRSVYINIQKFVQFQLTVNVVALMVNFISASFTGSAPLTIVQLLWVNLIMDTLGALALATEPPNDAMMKRPPVGRGDNFITKVMWRNIVGQSIYQLVVLGVLLLRGKSLLQINGPQAD

SEQ ID NO: 1323 - protein, 101 aa, Oryza sativa
PATLLYSSGTTGPSKGVVATHRSLISMVQIIMTRFRLEGSDKTETFLCTVPMFHVYGLVAFATGLLGCGATVVVLSKYELPEMLRSINAYGVTYLPLVPPI

SEQ ID NO: 1324 - protein, 76 aa, Oryza sativa
SAATEAISTPSVAPGSLSSTLNLRSLILSGDFFLAAVISCTLTKLVLRLEEVQPSMVEVNKACTGALLVMTSILQL

SEQ ID NO: 1325 - protein, 176 aa, Zea mays
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVRA

SEQ ID NO: 1326 - protein, 76 aa, Zea mays
MFISGFLLSAMMMLYFSSLGYIDVIWEEALGKLALVALAATVVECVPVTEVVDDNISVPLATMLVAFLLFSSNRTI

SEQ ID NO: 1327 - protein, 76 aa, Oryza sativa
GSVPEVAISPDDPVALPFSSGTTGLPKGVVLTHRSVVSGVAQQVDGENPNLHMGAGDVALCVLPLFHIFSLNSVLL

SEQ ID NO: 1328 - protein, 76 aa, Oryza sativa
LETPRTEPFYAEAALVLFEFEFAAITLVLLAGSLLGRMNIKAWMAFTPLWLLFSYTVGAFSLWGGGFLYQWGVIDY

SEQ ID NO: 1329 - protein, 76 aa, Zea mays
TLAAWPVTRNSQLFYFLMLAMYSGQIGLFSSRDLLLFFIMWELELIPVYLLLSMWGGKRRLYSATKFILYTAGGSI

SEQ ID NO: 1330 - protein, 101 aa, Solanum lycopersicum
TATDDFRKLASAIYLQVSTISQALIFVTRSRSWSFVERPGLLLVVALIVAQLVATLIAVYASWSFAAIEGIGWGWAGVIWLYNLVFYFPLDIIKFLIRYAL

SEQ ID NO: 1331 - protein, 76 aa, Zea mays
MALEAGYDYLHVAVVQCTPTQAAAVLGVLLLLAIRLAAAARSSSATSPKWKQHRLPPTPPGKLPIIGHLHLIGSHP

SEQ ID NO: 1332 - protein, 101 aa, Zea mays
VEAFTRGGAAGPVNIAYSGVYQWWYTIGLRTNEDLYTGALFLLFLSTLSLIGGWLHLQPKWKPSLSWFKNAESRLNHHLSGLFGVSSLAWTGHLVHVAIPG

SEQ ID NO: 1333 - protein, 76 aa, Zea mays
CLLSLGGLPPLAGFFGKLYLFWCGWQAGLYFLVSIGLLTSVLSIYYYLKIIKLLMTGRNQEITPYVRNYRRSPLRS

SEQ ID NO: 1334 - protein, 76 aa, Zea mays; identical to SEQ ID NO: 1333

SEQ ID NO: 1335 - protein, 101 aa, Solanum lycopersicum
VEAFTRGGALGPVNIAYSGVYQWWYTIGLRTNEDLYTGALFLLFLSAISLIAGWLHLQPKWKPSVSWFKNAESRLNHHLSGLFGVSSLAWTGHLVHVAIPA

SEQ ID NO: 1336 - protein, 76 aa, Oryza sativa
SLIGLVPLAERLSFLTEQIAFYTGPTVGGLLNATFGNVTEVIIALLALREGKIEVVKCSLLGSILSNLLLVLGTSL

SEQ ID NO: 1337 - protein, 101 aa, Oryza sativa
LGVFHTHAVAGFLGGATTGLFAEPILCSLFLSIPDSKGAFYGGPGGSQFGKQIAGALFVTAWNIVITSIICVIISLILPLRIADQELLIGDDAVHGEEAYA

SEQ ID NO: 1338 - protein, 76 aa, Oryza sativa
LKLGLAPPSWTDYLYLTVGGTLSNGGISGQTFKHGPQISNVLQLEVVTGKGEVVTCSPTEIPELFFAVLGGLGQFG

SEQ ID NO: 1339 - protein, 76 aa, Solanum lycopersicum
FFGIITGQKYLLMPKLLITFVMAIGIILTPIYSLSMPRQMFYGYKLFNAPKDSFFDSGPRELFLSISIFLPVIGIG

SEQ ID NO: 1340 - protein, 126 aa, Zea mays
MAKLVNKLVDSFDHDEAPAPDVGCVRAVLAELVLTFLFVFTGVSASMAAGAGGKPGEAMPMATLAAVAIAHALAAGVLVTAGFHVSGGHLNPAVTVGILVRGHITKLRALLYVAAQLLASSLACIL

SEQ ID NO: 1341 - protein, 76 aa, Zea mays
FWASSHSSLAPTVEIGGIWPPKGIGVLDPWEIPLLNTPILPSSGAAVTWAHHAILAGKEKRAVYALVATVLLALVS

SEQ ID NO: 1342 - protein, 76 aa, Oryza sativa
INGKLAGSAKGSASSSLISLQTPVTLVPGKNKIDLLSTTVGLSNYGAFFDLVGAGVTGPVKLSGPNGALNLSSTDW

SEQ ID NO: 1343 - protein, 201 aa, Zea mays
PSIAVISILLSFLVIPLGYRFVLADLSIGVFLWIAISSIAPIGLLMAGYSSNNKYSFLGGLRAAAQSISYEIPLTFCVLAISLLSNSLSTVDIVEAQSKYGFFGWNLWRQPIGFLVFLISSLAECERLPFDLPEAEEELVAGYQTEYSGIKYGLFYLVSYLNLLVSSLFVTVLYLGGWNFSIPYISFFGFFQMNKIIGILE

SEQ ID NO: 1344 - protein, 76 aa, Zea mays
MNWRSEHIWIELLKGSRKRGNFFWACILFLGSLGFLAVGASSYLGKNMISVLPSQQILFFPQGVVMSFYGIAGLFI

SEQ ID NO: 1345 - protein, 76 aa, Zea mays
MAKFALGHHREASDAGCVRAVLAELILTFLFVFAGVGSAMATGKLAGGGGDTVVGLTAVALAHTLVVAVMVSAGLH

SEQ ID NO: 1346 - protein, 76 aa, Zea mays
AYLPFKVNSSGVMPIIFSTSSLALPGTLARFSGLDFLKKAAIALNPGGALYLPTNVLLIAFFNYYYTFLQLDPDDL

SEQ ID NO: 1347 - protein, 176 aa, Zea mays
MERNGEIVNNGSIIIPGGGGPVTESPLDQFGIHPILDLNIGKYYVSFTNLSLSMLLTLGLVLLLVFVVTKKGGGKSVPNAFQSLVELIYDFVPNLVNEQIGGLSGNVKHKFFPCISVTFTFSLFRNPQGMIPFSFTVTSHFLITLALSFSIFIGITIVGFQRHGLHFFSFLLPAGV

SEQ ID NO: 1348 - protein, 101 aa, Oryza sativa
SAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGI

SEQ ID NO: 1349 - protein, 76 aa, Oryza sativa
EGASVGPLIKLAVDFDSSILVTAFVGTAIAFGCFTCAAIVAKRREYLYLGGLLSSGLSILLWLQFAASIFGHSTGS

SEQ ID NO: 1350 - protein, 76 aa, Zea mays
HITKLRAVLYVAAQLLASSAACVLLRFLSGGMVTPVHALGRGISPMQGLVMEVILTFSLLFVTYAMILDPRSQVRA

SEQ ID NO: 1351 - protein, 76 aa, Zea mays
RGHITKLRALLYVAAQLLASSLACILLRYLSGGMVTPVHALGAGIRPMQGLVMEVILTFSLLFVTYAMILDPRSQV

SEQ ID NO: 1352 - protein, 101 aa, Zea mays
HFNPAVTLAFATSGRFPWRQLPAYVLAQMLGATLASGTLRLMFGGRHEHFPGTLPTGSEVQSLVIEIITTFYLMFVISGVATDNRAIGELAGLAVGATILL

SEQ ID NO: 1353 - protein, 76 aa, Zea mays
TLFLGATLALAQRDIKRSLAYSTMSQLGYMMLALGIGSYQAALFHLITHAYSKALLFLGSGSVIHSMEPLVGYSPD

SEQ ID NO: 1354 - protein, 76 aa, Oryza sativa
AERVSFLTEQIALYTGPTVGGLLNATCGNATELIIALFALLKGKIEVVKCSLLGSVLSNLLLVLGTSLFCGGVVNL

SEQ ID NO: 1355 - protein, 76 aa, Solanum lycopersicum
IIPSPPAQPTCPIDALKLGACVDVLGGLIHIGIGGSAKQTCCPLLGGLVDLDAAICLCTTIRLKLLNINIILPIAL

SEQ ID NO: 1356 - protein, 101 aa, Solanum lycopersicum
ILAILSMILGNLIAITQTSMKRMLAYSSIGQIGYVIIGIIVGDSNDGYASMITYMLFYISMNLGTFACIVLFGLRTGTDNIRDYAGLYTKDPFLALSLALC

SEQ ID NO: 1357 - protein, 101 aa, Solanum lycopersicum; identical to SEQ ID NO: 1356

SEQ ID NO: 1358 - protein, 76 aa, Solanum lycopersicum
TVLLGATLALAQKDIKRGLAYSTMSQLGYMMLALGMGSYRSALFHLITHAYSKALLFLGSGSIIHSMETIVGYSPA

SEQ ID NO: 1359 - protein, 126 aa, Solanum lycopersicum
LKKRIAYSSVSHMGFIIIGISSLTDTGLNGALLQIISHGFIGAALFFLAGTTYDRIRLVYLDEMGGIAIPMPKMFTMFSSFSMASLALPGMSGFVAELIVFFGIITGQKYLLMPKLLITFVMAIGI

SEQ ID NO: 1360 - protein, 76 aa, Oryza sativa
NGWQLAAATFVGLQSMPGLVVLYGSIVKKKWAVNSAFMALYAYASTLIVWVLVGFRMAFGDRLLPFWGKAGAALTE

SEQ ID NO: 1361 - protein, 176 aa, Zea mays
FKKRIAYSSVSHMGFIIIGIGSITNIGLNGAILQILSHGFIGATLFFLAGTACDRMRLVYLEELGGISIPMPKIFTMFSSFSMASLALPGMSGFVAELVVFFGLITSPKFMLMPKMLITFVMAIGMILTPIYLLSMLRQMFYGYKLFHVPNKNFVDSGPRELFLLICIFLPVIGIG

SEQ ID NO: 1362 - protein, 76 aa, Zea mays
FFGLITSPKFMLMPKMLITFVMAIGMILTPIYLLSMLRQMFYGYKLFHVPNKNFVDSGPRELFLLICIFLPVIGIG

SEQ ID NO: 1363 - protein, 76 aa, Oryza sativa
ICVGAIDITQLSVAGYLFSSGKPYYALALLGLTIPQVVFQFQYFLKDPVKYDVKYQASAQPFFVLGLLVTALATSH

SEQ ID NO: 1364 - protein, 126 aa, Zea mays
MATVDATTTAGSGKQTDAAPSPPAAAAAACRSLSGADLALRVLLFAVTLSGLVVLATAEQTVRVPVPQIPGLVLSLPAKFKDSPALIYLLVALCVTCFYSLLSTAFTSLKLLFGSSPSRTLFLLVL

SEQ ID NO: 1365 - protein, 101 aa, Zea mays
MAKLHRLISAVLRLAAAGAAAAAAVIMVTSHETTSLFGIEMEAKYSYTPSFVFFVVAFAVTFAYSLLAAVLVRPGTTASRLVLLSDVTVGMLLTGAVAATG

SEQ ID NO: 1366 - protein, 76 aa, Solanum lycopersicum
MTWRSDDIWIELITGSRKISNFCWALILFLGSLGFLLVGTSSYLGRNLLSFFPPQQIIFFPQGIVMSFYGIAGLFI

SEQ ID NO: 1367 - protein, 76 aa, Oryza sativa
LKSDRERFSPNNILLMIAGGGLLWLGWAGFNGGAPYAPNVTATVAVLNTNVSAATSLLTWTCLDVIFFGKPSVIGA

SEQ ID NO: 1368 - protein, 76 aa, Solanum lycopersicum
MIFQSFLLGNLVSLCMKIINSVVVVGLYYGFLTTFSIGPSYLFLLRALVMEEGTEKKVSATTGFITGQLMMFISIY

SEQ ID NO: 1369 - protein, 76 aa, Zea mays
LLLCITIPFSLMTTIPDTSWYGILWTTRSNQIVEQGLINNVQQIGIHLATDFYLPFELISLILLVSLIGAITMARQ

SEQ ID NO: 1370 - protein, 76 aa, Oryza sativa
FIGVVAGVSNAINNGYESWGPLFGKLFFAFWVIVHLYPFLKGLVGRQNRTPTIVIVWSILLASIFSLLWVRIDPFL

SEQ ID NO: 1371 - protein, 76 aa, Oryza sativa; identical to SEQ ID NO: 1370

SEQ ID NO: 1372 - protein, 126 aa, Zea mays
LIAVSRYSGATFCPPSVFSRGIGWEGISIILDGMCGTLTGTAASVENAGLLAVTRVGSRRVIKISALFMIFFSLFAKFGAVLASIPLPIFAALYCVLFAYSAGAGFSLLQYCNLNSLRTKFILSIS

SEQ ID NO: 1373 - protein, 76 aa, Zea mays
MASNNLLVDLKRCFSAPSLRSYLAEFISTFLFVFTAVGSAISARMLTTPDVTSSAGPLVATAVAQAFGLFAAVLIA

SEQ ID NO: 1374 - protein, 76 aa, Oryza sativa
STIVTVAKWGRSVYVNIQKFVQFQLTVNVVALLVNFTSACFTGDAPLTAVQLLWVNMIMDTLGALALATEPPNNNL

SEQ ID NO: 1375 - protein, 176 aa, Zea mays
MAKFALGHHREASDAGCVRAVLAELILTFLFVFAGVGSAMATGKLAGGGGDTVVGLTAVALAHTLVVAVMVSAGLHVSGGHINPAVTLGLAATGRITLFRSALYVAAQLLGSTLACLLLAFLAVADSGVPVHALGAGVGALRGVLMEAVLTFSLLFAVYATVVDPRRAVGGMGPLL

SEQ ID NO: 1376 - protein, 101 aa, Oryza sativa
YTGPTVGGLLNATFGNATEMIIAIYALKNGMIRVVQQSLLGSILSNMLLVMGCAFFAGGIVHRNKDQVFSKATAVVNSGLLLMAVMGLMFPAVLHFTHSEV

SEQ ID NO: 1377 - protein, 76 aa, Zea mays
MVKLAFGSFRDSLSAASLKAYVAEFIATLLFVFAGVGSAIAYSQLTKGGALDPAGLVAIAIAHAFALFVGVSMAAN

SEQ ID NO: 1378 - protein, 76 aa, Solanum lycopersicum
ICNQFSGVSDRFVDTGYAIDSTYLLFSAYLVFSMQLGFAMLLAGSVRNTMNIMLTNVLDAAAGGLFYYLFGFAFAL

SEQ ID NO: 1379 - protein, 76 aa, Oryza sativa
LLQQVDDTLGVFHTHAVAGFLGGATTGLFAEPVLCSLFLPVTNSRGAFYPGRGGGLQFVRQVAGALFIICWNVVVT

SEQ ID NO: 1380 - protein, 76 aa, Oryza sativa
LRGGDVAFVLAPAGLDVPVLYFALLSIGAVVSPANPALTPAEVSRLVSLSGASVAFAVSSTATKLPAGLTTVVLLD

SEQ ID NO: 1381 - protein, 76 aa, Oryza sativa
NGVATIIGKIGLVFAILTFLVLLVRFLIDKGMTVGLLKWYSTDALTIVNYFATAVTIIVVAVPEGLPLAVTLSLAF

SEQ ID NO: 1382 - protein, 76 aa, Zea mays
LKALVYWVAQLLGSVVACLLLKIATGGAALGAFSLSAGVGAMNAVVLEMVMTFGLVYTVYATAVDPKKGDLGVIAP

SEQ ID NO: 1383 - protein, 76 aa, Oryza sativa
SLIGITPLAERLGYATEQLALYTGPTIGGLLNATFGNATEMIISLYALKNGMIRVVQQSLLGSILSNMLLVLGCAF

SEQ ID NO: 1384 - protein, 76 aa, Oryza sativa
LDITLGVAIGSSTQISMFVIPFCVVIGWMMGQKMDLNFQLFETATLFITVLVVAFMLQDGVANYLKGLMLILCYLI

SEQ ID NO: 1385 - protein, 76 aa, Zea mays
TYIYPAVAIILSPRYALLIDPLERFVFTMRSLQGALIIAGVFQAVVGFFGIWRVFIRFLSPLAAVPFVTLTGLGLF

SEQ ID NO: 1386 - protein, 76 aa, Oryza sativa
NEAVQDQLSALSFTSLAVIFGAGLVTSLSPCTLSVLPLTLGYIGAFGSGKDRSEVVGNSVAFSLGLATTLAILGVA

SEQ ID NO: 1387 - protein, 76 aa, Zea mays
NKYCLSSKIPLGVVLAIPPFNYPANLAGSKIGPALIAGNALVLKPPTQGAVAALHMVHCFHLAGFPKGLISCVTGK

SEQ ID NO: 1388 - protein, 76 aa, Oryza sativa
MAAAGAYSASLPAVPDWLNKGDNAWQLTASTLVGIQSMPGLVVLYGSIVKKKWAVNSAFMALYAYASSLLVWVLVG

SEQ ID NO: 1389 - protein, 76 aa, Solanum lycopersicum
VGRTAVTTTLAGSTAGIVTLFGRRLLVGHWDAMDVCNGVLGGFVAITSGCSVVEPWAAILCGFCAAWVLIGLNILA

SEQ ID NO: 1390 - protein, 101 aa, Solanum lycopersicum
VMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVG

SEQ ID NO: 1391 - protein, 76 aa, Zea mays
SALYVAAQLLGSTLACLLLAFLAVADSGVPVHALGAGVGALRGVLMEAVLTFSLLFAVYATVVDPRRAVGGMGPLL

SEQ ID NO: 1392 - protein, 101 aa, Zea mays
LHIFRGLYHASYSSPREFVWCLGVVIFLLMIVTAFIGYVPPWGQMSFWGATVITSLASAIPVVGDTIVTWLWGGFSVDNATLNRFFSLHHLLPLILAGASL

SEQ ID NO: 1393 - protein, 76 aa, Zea mays
QLQPIFAQWIQNIHAGAPGVTAPGATTSTSLTWGGGELVAIGGKVALLPIPLGTADFLVHHIHAFTIHVTVLILLK

SEQ ID NO: 1394 - protein, 76 aa, Zea mays
ILAILSMILGNLLAITQTSMKRMLAYSSIGQIGYVIIGIIVGDSNDGYASMITYMLFYISMNLGTFACIVLFGLRT

SEQ ID NO: 1395 - protein, 76 aa, Zea mays; identical to SEQ ID NO: 1394

SEQ ID NO: 1396 - protein, 76 aa, Zea mays
MAMGEALRAAAADAVVTFLWVLCVSTLGASTTAVTSYLRLQGVHFALLVTVSLLSVLLFVFNILCDALGGASFNPT

SEQ ID NO: 1397 - protein, 76 aa, Oryza sativa
VGRTAVTTTLAGSTAALTTLFGKRLQTGHWNVIDVCNGLLGGFAAITAGCSVVDPWAAIICGFVSAWVLIGLNALA

SEQ ID NO: 1398 - protein, 76 aa, Zea mays
MALQAAYEYLQQAVGHGAWSSTQTLTLLLIAVPTVLLLLASLAKSTSSSGRGKPPLPPSPPGTLPIVGHLHHIGPQ

SEQ ID NO: 1399 - protein, 101 aa, Zea mays
GGLSGNVKHKFFPCISVTFTFSLFRNPQGMIPFSFTVTSHFLITLALSFSIFIGITIVGFQRHGLHFFSFLLPAGVPLPLAPFLVLLELISHCFRALSSGI

SEQ ID NO: 1400 - protein, 76 aa, Oryza sativa
VGRTAVTTTLAGSVAALTTLFGKRLQTGHWNVVDVCNGLLGGFAAITAGCSVVDPWAAIICGFVSAWVLIGLNALA

SEQ ID NO: 1401 - protein, 76 aa, Oryza sativa
FYLAVGGSLLSYIYSAPPLKLKQNGWIGNFALGASYIGLPWWAGQALFGTLTPDIVVLTSLYSIAGLGIAIVNDFK

SEQ ID NO: 1402 - protein, 76 aa, Oryza sativa
LGQSFLLAQAVLPQTTQFYKGGGGADAVVETPWVNPLYPMATMVYFQCVFAAITLILLAGSLLGRMNIKAWMLFVP

SEQ ID NO: 1403 - protein, 76 aa, Zea mays
PSIAVISILLSFLVIPLGYRFVLADLSIGVFLWIAISSIAPIGLLMAGYSSNNKYSFLGGLRAAAQSISYEIPLTF

SEQ ID NO: 1404 - protein, 101 aa, Zea mays
VPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSS

SEQ ID NO: 1405 - protein, 76 aa, Oryza sativa
ETAAVEPLYPMATVVYFQCVFAAITLILVAGSLLGRMSFLAWMIFVPLWLTFSYTVGAFSLWGGGFLFHWGVIDYC

SEQ ID NO: 1406 - protein, 76 aa, Zea mays
MAMGATVRAAAADAVVTFLWVLCASALGASTAAVTSYLGVQEGAGHYALLVTTSLLSVLLFTFDLLCGALGGASFN

SEQ ID NO: 1407 - protein, 101 aa, Zea mays
VLGTTTPTGPHWHSLVIEIIVTFNMMFVTLAVATDTRAVGELAGLAVGSAVCITSIFAGAVSGGSMNPARTLGPALASNLYTGLWIYFLGPVLGTLSGAWT

SEQ ID NO: 1408 - protein, 76 aa, Zea mays
FGAISLLVLSVIPQLNTYVLGLPMVSMLVYVWSRENPNAQINIYGILQLKAFYLPWVMLLLDVIFGSPLMPGLLGI

SEQ ID NO: 1409 - protein, 76 aa, Zea mays
FGAISLLVLSIIPLFNSFFLGIPMVSMLLYVWSRENPNAQINIYGLVQLRSFYLPWAMLLLDVIFGSSLMPGLLGI

SEQ ID NO: 1410 - protein, 76 aa, Zea mays
NNISFWLLPPSLLLLLSSALVEVGSGTGWTVYPPLSGITSHSGGAVDLAIFSLHLSGVSSILGSINFITTIFNMRG

SEQ ID NO: 1411 - protein, 76 aa, Oryza sativa
LGLKQAKVVGMFSGGLNAASTLSVVIVVIYGANLTINGYMTTGSLTSFILYSLTVGSSVSALSGLYTTVMKASGAS

SEQ ID NO: 1412 - protein, 76 aa, Solanum lycopersicum
MDLSEPIHDFLLVFLGSGLILGGLGVVLLPNPIYSAFSLGLVLVCTSLFYILSNAYFVAAAQLLIYVGAINVLIIF

SEQ ID NO: 1413 - protein, 76 aa, Zea mays
GPTTPAGLIAAAVAHAFALFVAVSVGANISGGHVNPAVTFGAFVGGNITLFRGLLYWVAQLLGSTVACFLLRFSTG

SEQ ID NO: 1414 - protein, 76 aa, Zea mays
MDLPGPIHEILVLFGGFGLLLGGLGVVLLTNPIYSAFSLGLVLVCISLFYFLLNSYFVAVAQLLIYVGAINVLIIF

SEQ ID NO: 1415 - protein, 176 aa, Solanum lycopersicum
LSGVLTNHVTCLDELTSFSLSTKNGTVLDELITRAKVALAMLASVTTPNDEVLRQGLGKMPYWVSSRDRKLMESSGKDIIANRVVAQDGTGDYQTLAEAVAAAPDKNKTRYVIYVKMGIYKENVVVTKKKMNLMIVGDGMNATIITGSLNVVDGSTFPSNTLAAVGQGFILQDICI

SEQ ID NO: 1416 - protein, 101 aa, Solanum lycopersicum
IRLHQEMIMQSDKTIDARGVNVHITKGAGITLQYIKNVIIHGLHIHDIVEGNGGMVRDAVDHIGIRTKSDGDGISIFGASYIWIDHVSMQRCYDGLIDAVE

SEQ ID NO: 1417 - protein, 126 aa, Solanum lycopersicum
LTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAF

SEQ ID NO: 1418 - protein, 276 aa, Zea mays
YGFIAAFFVVEVSFISFAWFFVLKRELRPSELWASEKGYKAMTSNFRRYSYRELVKATRKFKVELGRGESGTVYKGVLEDDRHVAVKKLENVRQGKEVFQAELSVIGRINHMNLVRIWGFCSEGSHRLLVSEYVENGSLANILFSEGGNILLDWEGRFNIALGVAKGLAYLHHECLEWVIHCDVKPENILLDQAFEPKITDFGLVKLLNRGGSTQNVSHVRGTLGYIAPEWVSSLPITAKVDVYSYGVVLLELLTGTRVSELVGGTDEVHSMLRKL

SEQ ID NO: 1419 - protein, 151 aa, Oryza sativa
HGGGAATQGGFSDAIVVNEHYVLRVPAGLPLDSAAPLLCAGVTVYSPMVIHGLNAPGKHVGVVGLGGLGHVAVKFAKAFGMRVTVISTSPGKRQEALEHLGADEFLVSRDAGQMAAAAATMDGILNTVSAWHPIAPLFSLMKPMAQMVFVG

SEQ ID NO: 1420 - protein, 226 aa, Oryza sativa
DLHFIHNDWGITMYPVVPGHEITGVVTKVGTNVAGFKVGDRVGVGCIAASCLDCEHCRRSEENYCDKVALTYNGIFWDGSITYGGYSGMLVAHKRFVVRIPDTLPLDAAAPLLCAGITVYSPMKQHGMLQADAAGRRLGVVGLGGLGHVAVKFGKAFGLHVTVISTSPAKEREARENLKADNFVVSTDQKQMQAMTRSLDYIIDTVAATHSLGPILELLKVNGKLV

SEQ ID NO: 1421 - protein, 151 aa, Oryza sativa
DFDAEAVFDQEFINVKLSDYIGKKYVILFFYPLDFTFVCPTEITAFSDRYDEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQALQ

SEQ ID NO: 1422 - protein, 201 aa, Zea mays
LAGSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAKLKVGPPEDDSDITPVVTESSANFIEGLVMDAKEKGATFCQEYRREGNLIW

SEQ ID NO: 1423 - protein, 251 aa, Zea mays
LWKRADVLHKAAAILKEHKAPIAECLVKEIAKPAKDAVSEVVRSGDLVSYTAEEGVRILGEGKLVVSDSFPGNERNKYCLSSKIPLGVVLAIPPFNYPANLAGSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAK

SEQ ID NO: 1424 - protein, 126 aa, Oryza sativa
LPLDGAAPLLCAGVTVYSPMVIHGLNAPGKHVGVVGLGGLGHVAVKFAKAFGMRVTVISTSPGKRREALEHLGADEFLVSRDAGQMAAAAGTMDGILNTVSAWHPVAPLFALMKPMAQMVFVGAPT

SEQ ID NO: 1425 - protein, 76 aa, Zea mays
VLDSVNITLGAEDELKDAVGLVRPVSVAFEVITGFRLYKSGVYTSDHCGTTPMDVNHAVLAVGYGVEDGVPYWLIK

SEQ ID NO: 1426 - protein, 151 aa, Oryza sativa
VVKNDWGNAMYPVVPGHEIVGVVTGVGAGVTKFKAGDTVGVGFFVGSCRTCDSCGKGYENYCPTMVITSNGKDYGGAATQGGFSDAIVVNEHYVLRVPAGLPLDGAAPLLCAGVTVYSPMVIHGLNAPGKHVGVVGLGGLGHVAVKFAKAF

SEQ ID NO: 1427 - protein, 76 aa, Oryza sativa
TRRVQQEDDVTIKVLYCGICHTDLHIIKNEWGNAMYPVVPGHEIVGVVTGVGAGVTKFKAGDTVGVGYFVDSCRAC

SEQ ID NO: 1428 - protein, 251 aa, Zea mays
NIQVICVTDGERILGLGDLGCQGMGIPVGKLALYTALGGVDPSVCLPITIDVGTNNEFLLNDEFYIGLRQKRATGEEYDELIEEFMSAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIE

SEQ ID NO: 1429 - protein, 151 aa, Zea mays
LWKRADVLHKAAAILKEHKAPIAECLVKEIAKPAKDAVSEVVRSGDLVSYTAEEGVRILGEGKLVVSDSFPGNERNKYCLSSKIPLGVVLAIPPFNYPANLAGSKIGPALIAGNALVLKPPTQGAVAALHMVHCFHLAGFPKGLISCVTGK

SEQ ID NO: 1430 - protein, 226 aa, Solanum lycopersicum
SIAERTQFVAYLIYSSFLTGFVYPIVSHWFWSGDGWASASKTDGNLLLRFGVIDFAGSGVVHMVGGIAGLWGAFIEGPRIGRFDRSGRSVALRGHSASLVVLGTFLLWFGWYGFNPGSFLTILKSYDHTIRGTYYGQWSAIGRTAVTTTLAGCTAALTTLFCKRLLVAHWNVVDVCNGLLGGFAAITSGCAVVEPWAAIVCGFIAAWVLIGFNALAAKLKYDDPLE

SEQ ID NO: 1431 - protein, 151 aa, Zea mays
GGAISPFGNAACAGLAVATVILSTGHISGAHLNPSLTIAFAALRHFPWLQVPAYVAVQALASVCAAFALKGVFHPFLSGGVTVPDATVSTAQAFFTEFIISFNLLFVVTAVATDTRAVGELAGIAVGAAVTLNILVAGPTTGGSMNPVRTL

SEQ ID NO: 1432 - protein, 251 aa, Zea mays
MEPGSTPPNGSAPATPGTPAPLFSSGGPRVDSLSYERKSMPRCKCLPLPAVEGWGVATHTCVVEIPAPDVSLTRKLGAEFVGTFILIFFATAAPIVNQKYGGAISPFGNAACAGLAVATVILSTGHISGAHLNPSLTIAFAALRHFPWLQVPAYVAVQALASVCAAFALKGVFHPFLSGGVTVPDATVSTAQAFFTEFIISFNLLFVVTAVATDTRAVGELAGIAVGAAVTLNILVAGPTTGGSMNPVRTL

SEQ ID NO: 1433 - protein, 276 aa, Zea mays
SRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELEDPLILIHDKKVTNMHAVVKVLEMALKKQKPLLIVAEDVESEALGTLIINKLR

SEQ ID NO: 1434 - protein, 151 aa, Solanum lycopersicum
RKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWNDHWIFWVGPMIGAALAAIYHQI

SEQ ID NO: 1435 - protein, 276 aa, Solanum lycopersicum
MATPQQPLLTKTHKQNSIISFKILTFVVTLFVALFLVVFLVAPYQFEIKHSNLCKTAQDSQLCLSYVSDLMSNEIVTTDSDGLSILMKFLVNYVHQMNNAIPVVSKMKNQINDIRQEGALTDCLELLDQSVDLVSDSIAAIDKRTHSEHANAQSWLSGVLTNHVTCLDELDSFTKAMINGTNLDELISRAKVALAMLASVTTPNDDVLRPGLGKMPSWVSSRDRKLMESSGKDIGANAVVAKDGTGKYRTLAEAVAAAPDKSKTRYVIYVKRGIYK

SEQ ID NO: 1436 - protein, 276 aa, Solanum lycopersicum
MATPQQPLLTKTHKQNSIISFKILTFVVTLFVALFLVVFLVAPYQFEIKHSNLCKTAQDSQLCLSYVSDLISNEIVTSDSDGLSILKKFLVYSVHQMNNAIPVVRKIKNQINDIREQGALTDCLELLDLSVDLVCDSIAAIDKRSRSEHANAQSWLSGVLTNHVTCLDELDSFTKAMINGTNLDELISRAKVALAMLASVTTPNDEVLRPGLGKMPSWVSSRDRKLMESSGKDIGANAVVAKDGTGKYRTLAEAVAAAPDKSKTRYVIYVKRGTYK

SEQ ID NO: 1437 - protein, 101 aa, Oryza sativa
DPEATKNTIDEDGWLHTGDIGFVDDDDEIFIVDRLKEIIKYKGFQVPPAELEALLITHPEIKDAAVVSMKDDLAGEVPVAFIVRTEGSEITEDEIKKFVAK

SEQ ID NO: 1438 - protein, 76 aa, Solanum lycopersicum
KLEGILQEKESGIWVQLDKTLDNIRMMVDTVFKRMDVMLQLSKTSLHHWQEEHLIKVELESMVMQCVIRTVQEEFE

SEQ ID NO: 1439 - protein, 201 aa, Solanum lycopersicum
KKYFLTLKILKGKTKLFRKVSKETTKLFIKSIGFLKKIKKELSKVNLIVLFRFKEISESNETKKEKDYLISNQIINESFRQIESGNWPNSSLIETKMKDLTNRTSTIKNKIERITKEKKKVTPEIDINPNKTNNIKKFESPKKIFQILKSRNTRVIWKFHYFLKLFIQRLYINLFLSIINIPRITTQLFLKSTNKLIEKFI

SEQ ID NO: 1440 - protein, 151 aa, Zea mays
VQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEF

SEQ ID NO: 1441 - protein, 101 aa, Zea mays
DLMDDIVHAARNQSKSDKPVVGHIAKEAPEGKLLETWIKKLSGSGLRLVDVTNGFSELFAVKDTTEITCVKKAAYLTSSVLKNFVIPKLEKVIDEEKEVSH

SEQ ID NO: 1442 - protein, 76 aa, Solanum lycopersicum
EVELKEVKLKEGYYVMDPAKAVEIVDENTICVAAILGSTLTGEFEDVKLLNELLTKKNKETGWETPIHVDAASGGF

SEQ ID NO: 1443 - protein, 126 aa, Oryza sativa
GEQIMKGYLNDPESTKNTIDKGGWLHTGDIGYVDDDDEIFIVDRLKEIIKYKGFQVPPAELEALLITHPDIKDAAVVPMIDEIAGEVPVAFIVRIEGSAISENEIKQFVAKEVVFYKRLNKVFFAD

SEQ ID NO: 1444 - protein, 226 aa, Zea mays
MDPKATSTSKTDNIDQITIIEEKVNKIGTEPTIRKYSKGRMLGKGGFAKCYEVTNLENKKVLAGKIICKASLTKSRAKQKLISEIKIHKSLRHSNIVEFEHVFEDQENVYILLELCPNQSLHDLIKRRKRLTEIEVQCYTLQLICGLKYLHSRRVIHRDLKLGNLLLNDKMELKICDFGLAAKLEFDGEKRKTVCGTPNYIAPEVIEGKGGHSYEVDTWSLGVIIY

SEQ ID NO: 1445 - protein, 101 aa, Zea mays
SWSPSEQSADREHLTEEEKIMFRRIGRKMDGLVLLGRRGIFDGVIEEIHQHWKHKEVVKVITKQNQTRQIMYAASLLEVETGGILIAVEKLTTSHAIILYR

SEQ ID NO: 1446 - protein, 76 aa, Zea mays
HSRRVIHRDLKLGNLLLNDKMELKICDFGLAAKLEFDGEKRKTVCGTPNYIAPEVIEGKGGHSYEVDTWSLGVIIY

SEQ ID NO: 1447 - protein, 126 aa, Oryza sativa
GWLKTGDLCYIDEDGYLFVVDRLKELIKYKGYQVPPAELEALLLTHPEVTDVAVIPFPDREVGQFPMAYIVRKKGSNLSEREVMEFVAKQVAPYKKVRKVAFVTDIPKNASGKILRKDLIKLATSK

SEQ ID NO: 1448 - protein, 126 aa, Oryza sativa
MKGYLNDPEATAATIDVEGWLHTGDIGYVDDDDEVFIVDRVKELIKFKGFQVPPAELESLLIAHPSIADAAVVPQKDDVAGEVPVAFVVRAADSDITEESIKEFISKQVVFYKRLHKVHFIHAIPK

SEQ ID NO: 1449 - protein, 76 aa, Solanum lycopersicum
FMITLSHANRLPVTIQYPYEKLITSERFRGRIHFEFDKCIACEVCVRVCPIDLPVVDWKLETDIRKKRLLNYSIDF

SEQ ID NO: 1450 - protein, 126 aa, Zea mays
KCVVLDIEGTTTPISFVTDVMFPYARDNVRKHLTSTFDFEETKEDIKLLRIQIEDDLQNGVAGAVPVPPDEGGKEEVINSLVANVESMIKADRKITSLKQLQGHIWRIGFQKKELQGVVFEDVPVA

SEQ ID NO: 1451 - protein, 176 aa, Zea mays
IVPTSTNIDDCLSVIALPLPHRPLFPGFYMPINVKDQKLLQALIENRKRSAPYAGAFLVKDEEGTDPNIVTGSDSAKSIDDLKGKDLLKRLHEVGTLAQITSIQGDHVVLLGHRRLRITEMVEEDPLTVKVDHLKEKPYNKDDDVMKATSFEVISTLREVLRTSSLWKDHVQTYTQ

SEQ ID NO: 1452 - protein, 201 aa, Solanum lycopersicum
ERWDDYASVGYKSEKVKVFFSVFYKSIEELATIAEIKQGRSVKNHLINLWLELMKLMLMERVEWCSGKTIPSIEEYLYVTSITFCAKLIPLSTQYFLGIKISKDLLESDEICGLWNCSGRVMRILNDLQDSKREQKEVSINLVTLLMKSMSEEEAIMKIKEILEMNRRELLKMVLVQKKGSQLPQLCKDIFWRTSKWAHFT

SEQ ID NO: 1453 - protein, 126 aa, Zea mays
ILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNIDKEDWKLDTLCDLYETLAI

SEQ ID NO: 1454 - protein, 101 aa, Zea mays
DPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEE

SEQ ID NO: 1455 - protein, 151 aa, Zea mays
LTMLLTQDEGVKNFIASLTSQLSEWLEAGKLQRIVLVIMSKATSEVLERWNFNIVTDAEVVEKGAIKEKSDKEIMREIQAIMRQIASCITYLPCLDEPCVFDVLAYTDTDVDAPGTWVESDAKLIDNPQMVKLHSFDTKIHKVDTLVSYKK

SEQ ID NO: 1456 - protein, 251 aa, Oryza sativa
SVSKAKVKLLVNHFIVKYRQASTVFHYDIDIKLDISSPKASDKELSKGDFLTVKDELFKDESFRRLSSAVAYDGKRNLFTCAELPDGLFRVKVRSRTYIVSVEFKKKLPLSQLSELPVPREVLQGLDVIVREASSWRKIIIGQGFYSQGRSVPIGPDVVALKGTQQTLKCTQKGLILCVDYSVMPFRKAGPVLDLVQKSVRYLDYRTTLNKHQLDTLKNELKGQRVTVNHRRTKQKYIVKGLTDKPASQIT

SEQ ID NO: 1457 - protein, 101 aa, Solanum lycopersicum
VIINPKLKKKGNKTALFFEGCLSVDGFRAVVERHLEVEVTGLDRNGKAIKVDASGWQARILQHEYDHLDGTLYVDKMAPRTFRTVENLDLPLAAGCPKLGV

SEQ ID NO: 1458 - protein, 76 aa, Solanum lycopersicum
MESKFAHIIVFFLLATSFETLMARKEIDGPEVIELLKEFDSNLMCEGKQMWPELIGVPTKLAKEIIEKENPSITNI

SEQ ID NO: 1459 - protein, 76 aa, Oryza sativa
AWEALFHVDDPGPRVPIAKGKFLDVNQALEVVRFDIQYCDWRARQDLLTIMVLHNKVVEVLNPLAREFKSIGTLRK

SEQ ID NO: 1460 - protein, 101 aa, Solanum lycopersicum
EGHKHIIPKLKEICDISSKLGIQIITAFAFSTENWKRSKEEVDFLLQMFEEIYDEFSRSGVRVSIIGCKSDLPMTLQKCIALTEETTKGNKGLHLVIALNY

SEQ ID NO: 1461 - protein, 201 aa, Oryza sativa
RVLGEPLTPAERAFLVSKCQKSRTKKQINLGRDGLTHNMLNDIHNHWKNDEAVRVKCLGVPTVDMQNVCHQLEDKTGGLIIHRHGGQLILYRGRHYNPKKRPVIPLMLWKPAEPVYPRLIKTTIEGLTVEETKEMRKKGLYVPVLTKLAKNGYYASLVPMVRDAFLTDELVRIDSKGLPKSDYRKIGVKLRDLVPCIIVSF

SEQ ID NO: 1462 - protein, 151 aa, Zea mays
KVFYDHWKEHKSDLWGSSDAIAIATPPPSDDLRYLKSSALDIWLLGYEFPETIIVFMHKQIHVLSSQKKGNLIGTLKKAANEAVGVDIVLHVKTKNSDGADLMDDIVHAARNQSKSDKPVVGHIAKEAPEGKLLETWIKKLSGSGLRLVDV

SEQ ID NO: 1463 - protein, 176 aa, Oryza sativa
NMIDDIHNHWKRAEAVRIKCLGVPTLDMDNICFHLEDKTGGKVIYRNINILILYRGRNYDPKQRPQIPLMLWKPLAPIYPRLVQNVADGLTFEKTKELRNTGLNSSPLMKLTRNGVYVNVVDRVREAFKTVEVVRLDCSHVGSSDCKKIGVKLRDLVPCVPLLFKDEQIILWRGKV

SEQ ID NO: 1464 - protein, 101 aa, Zea mays
DLSVLRYTPVFQDASASAYQIMSYFLLDIDYGIHTNLLKKTNTDGRYIRDIYEFMWGCLIKYLIAEEKIELAIKLLTPNEKDQESVLAKIVSIFDRNVVKK

SEQ ID NO: 1465 - protein, 226 aa, Oryza sativa
RWRQAVGTIVKNRRRRFRWVPDLDRRSLDKAKVRSTQEKIRVALYVQQAALIFSDDELALITSKHDSKALKMHGGVDGISKKVRSSFDHGICASDLDTRQNIYGVNRYAEKPSRSFWMFVWDAFQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPAD

SEQ ID NO: 1466 - protein, 76 aa, Zea mays
GVQNVLDFLQDDFHDMDVISISGNFCSDKKPSAVNWIEGRGKSVVCEAVIGEEVVKKVLKTDVQSLVELNTIKNLA

SEQ ID NO: 1467 - protein, 76 aa, Oryza sativa
TGLNSSPLMKLTRNGVYVNVVDRVREAFKTVEVVRLDCSHVGSSDCKKIGVKLRDLVPCVPLLFKDEQIILWRGKV

SEQ ID NO: 1468 - protein, 101 aa, Zea mays
WPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKD

SEQ ID NO: 1469 - protein, 151 aa, Zea mays
VAELSGLRVDEAIGRHILTLVEDSSVSLVQRMLYLALQGREEKEVRFELKTHGSKRDDGPVILVVNACASRDLHDHVVGVCFVAQDMTVHKLVMDKFTRVEGDYKAIIHNPNPLIPPIFGADQFGWCSEWNAAMTKLTGWHRDEVVDKMLL

SEQ ID NO: 1470 - protein, 151 aa, Solanum lycopersicum
VTDEVFIAMSKALNFINPDELSMQCILIALNRFLQEKHGSKMAFLDGNPPERLCMPIVEHIESKGGQVRLNSRIKKIELNEDGSVKSFILSDGSAIEGDAFVFAAPVDIFKLLLPEDWKEIPYFQKLEKLVGVPVINVHIWFDRKLKNTYD

SEQ ID NO: 1471 - protein, 201 aa, Solanum lycopersicum
INNKDLLAFSIHDFELCQAQHREELQQLKRWFEDYRLDQLGLAERYIHASYLFGVTVIPEPELSDARLMYAKYVMLLTIVDDHFESFASKDECFNIIELVERWDDYASVGYKSEKVKVFFSVFYKSIEELATIAEIKQGRSVKNHLINLWLELMKLMLMERVEWCSGKTIPSIEEYLYVTSITFCAKLIPLSTQYFLGIKI

SEQ ID NO: 1472 - protein, 101 aa, Zea mays
IDGDGDVKDDIVGLEGASPKSMPPIWAEVMRFLTNPHKPMILALSRPDPKKNITTLVKAFGECRPLRELANLTLIMGNRDDIDDMSAGNASVLTTVLKLID

SEQ ID NO: 1473 - protein, 76 aa, Oryza sativa
MIVDKVWIGDVKFVGDKKNSELKSTISERVMAILIQGIFVNTASEVVKGDDGKNTILGLATETALLEFGLSLEEHL

SEQ ID NO: 1474 - protein, 151 aa, Solanum lycopersicum
LESGCFSASIDEIETLKNKAEEVEEYLDGRCVYLVGMMGCGKTTVGRILAETLGYSFFDCDRLIEQAVGGITVAEIFELRGESFFRDNETEVLHKLSLMHRLVVSTGGGAVVRPINWRHMHKGISVWLDVPLEALAKRITTEGTKSRPLLH

SEQ ID NO: 1475 - protein, 101 aa, Oryza sativa
MHHQKFIEGKVVMDVGCGTGILSVFCARAGAKCVYAVEASEMATQAREIVKANNLDDKVVVVHGRVEDVEVEDKVDVIISEWMGYMLLYESMLPSVLFARD

SEQ ID NO: 1476 - protein, 176 aa, Zea mays
QDFHDMSEKMLTEMINRIVKDVQRRGSSMVVYFHNLSQFDGIMILSFLTKSYKNCHIEPIMRNDCIYSIKLYKVSKNGDKRLVLTFMDSYLLLKVKLADLADSFCPELGGKGSFDHQNVTVDKLPSIREDSLTYLKQDILITAAVMQRAKAIIWEEYGIDILKVLTISALALKIFR

SEQ ID NO: 1477 - protein, 226 aa, Solanum lycopersicum
ISCKSCNNFKITIEAIEEAYEKGQQANVKIKGLILTNPCNPLGTILDRDTLKKISTFTNEHNIHLVCDEIYAATVFNSPKFVSIAEIINEDNCINKDLVHIVSSLSKDLGFPGFRVGIVYSFNDDVVNCARKMSSFGLVSTQTQHLLAFMLSDDEFVEEFLIESAKRLRERYEKFTRGLEEIGIKCLESNAGVYCWMDLRSLLKEATLDAEMSLWKLIINEVKLNV

SEQ ID NO: 1478 - protein, 276 aa, Zea mays
SRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKAQKCELEDPLILIHDKKVTNMHAVVKVLEMALKKQRPLLIVAEDVESEALGTLIINKLR

SEQ ID NO: 1479 - protein, 76 aa, Oryza sativa
GLNAIIVLEMEEELDIVVEQSARLGVEPVIGVRAKLLTKIPGHFGSTAGKHGKFGMLADKIYEVAGKLKKMGKLHW

SEQ ID NO: 1480 - protein, 176 aa, Oryza sativa
KHRVSLHDVYVYHGRRVIAKSLTLESLKADRDSTFLIMPRMRGGCNDTIGGFKCIPLEQHIRSLGDSLFEIIWIPPDLRVSGFCSYLIILGKPARKIICQLLKLLEIIHAANRFASRFTIADLVFLPDLGCIAFKKGVKIRWNLRREEYKLNMGDVASIISCWFRFNRRKLEALEA

SEQ ID NO: 1481 - protein, 276 aa, Oryza sativa
MIVDKVWIGDVKFVGDKKNSELKSTISERVMAILIQGIFVNTASEVVKGDDGKNTILGLATETALLEFGLSLEEHLYDDYNKLTRIKVDPFNSVKKKMSVTIQLPNGGIRTFCKGASEIILEQCNTIHNTDGNIVPLSEMQKHNVLNIINSFASEALRTLCIAFKDMDEFPNDQPISDDGYTLIAVFGIKDPVRPGVKDAVRTCMAAGIRVRMVTGDNINTAKAIAKECGILTEDGIAIEGQQLNNKSSDELKELLPKIQVIARSLPMDKYKLVTS

SEQ ID NO: 1482 - protein, 76 aa, Oryza sativa
KHRVSLHDVYVYHGRRVIAKSLTLESLKADRDSTFLIMPRMRGGCNDTIGGFKCIPLEQHIRSLGDSLFEIIWIPP

SEQ ID NO: 1483 - protein, 276 aa, Oryza sativa
SDVDAIDEAQRRKILVRVKQYHLPPELIEEGFCISPDELAAIANMREDYTMLRMHGGINGISRKIKASLEDGAKETDIATRQMLYGANRHAEKPPRSFWMFVWDALHDLTLIILVVCALVSIVVGLATKGWPMGIYDGFGIILSILLVVLVTATSDYQQARKFMELDREKQKIYIRVTRDKKTKEVLVHDLVVGDILHLSIGDVVPADGLFISGDCLMIDESSLSGESEPVNISEERPFLHAGNKVVDGAAKMLVTAVGTRTEWGKIMGTLNGDGV

SEQ ID NO: 1484 - protein, 101 aa, Zea mays
PQFKGLDLEFDVPLRELGFHGVPYKASAFIIPTSTCLVELIETPFLVVSLSEIEIVNLERVGFGTKNFDMAIVFKDFKKDVLRIDSIPSASLDAIKEWLDT

SEQ ID NO: 1485 - protein, 276 aa, Solanum lycopersicum
EVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDFSHSLAERLVSDIEKILSELDTQPPR

SEQ ID NO: 1486 - protein, 251 aa, Solanum lycopersicum
RGILVIGSIGTGRSYLVKYLATNSYVPFITVFLNKFLDNKSKGFLLDEIDIDDSDDIDDSDNLDASDDIDRDLDTELELLTRMNGLTVDMMPEIDRFYITLQFELAKAMSPCIIWIPNIHDLDVNESNDLSLGLLVNHLSRDCERCSTRNILVIASTHIPQKVDPALIAPNKLNTCIKIRRLLIPQQRKHFFTLSYTRGFHLEKKMFHTNGFGSITMGSNARDLVALTNEVLSISITQKKSIIDTNTIRSA

SEQ ID NO: 1487 - protein, 176 aa, Oryza sativa
MIVDKVWIGDVKFVGDKKNSELKSTISERVMAILIQGIFVNTASEVVKGDDGKNTILGLATETALLEFGLSLEEHLYDDYNKLTRIKVDPFNSVKKKMSVTIQLPNGGIRTFCKGASEIILEQCNTIHNTDGNIVPLSEMQKHNVLNIINSFASEALRTLCIAFKDMDEFPNDQPI

SEQ ID NO: 1488 - protein, 101 aa, Zea mays
TPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGV

SEQ ID NO: 1489 - protein, 76 aa, Oryza sativa
HMLWVGERTRQLDGAHVEFLRGVANPLGIKVSDKMNPTELVKLIEILNPSNKPGRITIITRMGAENMRVKLPHLIR

SEQ ID NO: 1490 - protein, 76 aa, Oryza sativa
RVRVCTPEDGAWNMKDKKVVNGATIKSWACVNLCEGLDNRVVEAFCLQLVRTSKITGLDFANVSLPILKADPHNVK

SEQ ID NO: 1491 - protein, 101 aa, Zea mays
KMAFLDGNPPERLCMPIVDHIRSRGGEVRLNSRIKKIELNPDGTVKHFALSDGTQITGDAYVCATPVDIFKLLVPQEWSEITYFKKLEKLVGVPVINVHIW

SEQ ID NO: 1492 - protein, 76 aa, Zea mays
ADSFCPELGGKGSFDHQNVTVDKLPSIREDSLTYLKQDILITAAVMQRAKAIIWEEYGIDILKVLTISALALKIFR

SEQ ID NO: 1493 - protein, 126 aa, Solanum lycopersicum
ILPGSSSLMVRNNSIVGVDTQITLNLRSRVGGLVRVERKKKRIELKIFSGDIHFPGETDKISRHTGVLIPPGTGKRNSKEYKKVQNWIYVQRITPSKKRFFVLVRPVVTYEITDGINLGTLFPPDP

SEQ ID NO: 1494 - protein, 126 aa, Solanum lycopersicum
IVSLRYQRIHILQIRDSGDLVDVRAIGEFCREDDELFLNSNSQVLVNHVGNGFHHSLPQSETSFLSGIKQRLLSYIFRGIWNEADQTMRVQCLKKKFYFHFQDYIDLIIWKVQFLDRHHLLIKFGS

SEQ ID NO: 1495 - protein, 101 aa, Solanum lycopersicum
ERWDDYASVGYKSEKVKVFFSVFYKSIEELATIAEIKQGRSVKNHLINLWLELMKLMLMERVEWCSGKTIPSIEEYLYVTSITFCAKLIPLSTQYFLGIKI

SEQ ID NO: 1496 - protein, 226 aa, Solanum lycopersicum
MSSLVLQCWKLSSPSLILQQNTSISMGAFKGIHKLQIPNSPLTVSARGLNKISCSLNLQTEKLCYEDNDNDLDEELMPKHIALIMDGNRRWAKDKGLEVYEGHKHIIPKLKEICDISSKLGIQIITAFAFSTENWKRSKEEVDFLLQMFEEIYDEFSRSGVRVSIIGCKSDLPMTLQKCIALTEETTKGNKGLHLVIALNYGGYYDILQATKSIVNKAMNGLLDVE

SEQ ID NO: 1497 - protein, 276 aa, Oryza sativa
DVILCLLPLFHIYSLNSVLLAGLRAGSTIVIMRKFDLGALVDLVRKHNITIAPFVPPIVVEIAKSPRVTAEDLASIRMVMSGAAPMGKDLQDAFMAKIPNAVLGQGYGMTEAGPVLAMCLAFAKEPFKVKSGSCGTVVRNAELKIVDPDTGTSLGRNQSGEICIRGEQIMKGYLNDPEATKNTIDEDGWLHTGDIGFVDDDDEIFIVDRLKEIIKYKGFQVPPAELEALLITHPEIKDAAVVSMKDDLAGEVPVAFIVRTEGSEITEDEIKKFVAK

SEQ ID NO: 1498 - protein, 151 aa, Zea mays
KNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVH

SEQ ID NO: 1499 - protein, 151 aa, Solanum lycopersicum
VCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRLEKVYGTEHSHILRVPFGTEKGIVRKWISRFEVWPYMETFIEDVAKEISAE

SEQ ID NO: 1500 - protein, 76 aa, Zea mays
IHSGTVVGKLEGEREITLGFVDLLRDDFIEKDRSRGIFFTQDWVSMPGVIPVASGGIHVWHMPALTEIFGDDSVLQ

SEQ ID NO: 1501 - protein, 226 aa, Solanum lycopersicum
KPLWRLVLEQFDDTLVKILLGAAFISFVLAYVNQDETGESGFEAYVEPLVILWILVLNAIVGVWQESNAEKALEALKEMQGESAKVLRDGYLVPDFPAKELVPGDIVELRVGDKVPADMRVATLKSSTLRVEQSSLTGESMPVTKSTDFLATDDCELQAKENMVFAGTTVVNGSCICIVVNTGMCTEIGKIQRQIHDASMEESDTPLKKKLDEFGNRLTFAIGVVC

SEQ ID NO: 1502 - protein, 76 aa, Oryza sativa
DKVMQGYAYILTHPGVPCIFYDHVFDWNLKQEISTLAAVRSRNEIHPGSKLKILAAEGDVYVAMIDDKVITKIGTR

SEQ ID NO: 1503 - protein, 176 aa, Zea mays
ARFLSEACDLVFDAASQGKSFLIVGTKKRAADLVASAAIRSRCHYVNKKWFSGMLTNWSITKTRLSQFRDLRAEEKMGKFHHLPKRDAAILKRKLSTLQRYLGGIKYMTRLPDIVIVLDQQKEYIALQECAILGIPTISLVDTNCDPDLANISIPANDDTMTSIRLILNKLVFAIS

SEQ ID NO: 1504 - protein, 101 aa, Solanum lycopersicum
DINPNKTNNIKKFESPKKIFQILKSRNTRVIWKFHYFLKLFIQRLYINLFLSIINIPRITTQLFLKSTNKLIEKFISNNEINQEKINNQKKIHFMFISTIK

SEQ ID NO: 1505 - protein, 126 aa, Solanum lycopersicum
IKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEQDRSRGIYFTQDWVSLPGVLP

SEQ ID NO: 1506 - protein, 126 aa, Solanum lycopersicum
LELSAVLRLNNIEVNMVYPEPWCMPRLFTEGIAAFYEGYYKNKGVNIIKGTVAVGFDTHPNGEVKEVKLKDGRVLEADIVVVGVGARPLTTLFKGQVEEEKGGIKTDAFFKTSVPDVYAVGDVATF

SEQ ID NO: 1507 - protein, 276 aa, Oryza sativa
RSLDKAKVRSTQEKIRVALYVQQAALIFSDGAKKKEYKLTGDIIKAGYAINPDELALITSKHDSKALKMHGGVDGISIKVRSSFDHGIYASELDTRQNIYGVNRYAEKPSRSFWMFVWDALQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPADGLYIHGYSLLIDESSLSGESDPVYVSQDKPFILAGTKVQDGSAKMIVTAVGMR

SEQ ID NO: 1508 - protein, 151 aa, Solanum lycopersicum
GDILSIPLVIYQRSNKNTCMHQKFRVPRGKCIKKGQILADGAATVGGELALGKNVLVAYMPWEGYNSEDAVLISERLVYEDIYTSFHIRKYEIHTHVTSQGPEKVTNEIPHLEAHLLRNLDKKGIVMLGSWVETGDILVGKLTPQVVKESS

SEQ ID NO: 1509 - protein, 76 aa, Solanum lycopersicum
MRIFVFLVLLTVAIGTENLNSHVFPRPLIIEYPEKQLRDELKCTTWRFVVETNNLSPWKTIPEECADYVKEYMVGP

SEQ ID NO: 1510 - protein, 226 aa, Solanum lycopersicum
RQLPEWYAEKGISLILSTEIVKADLASKTLVSAAGESFKYQTLVIATGTTVLKLSDFGVQGADSKNIFYLREIDDADQLVEALKAKKNGKAVVVGGGYIGLELSAVLRLNNIEVNMVYPEPWCMPRLFTEGIAAFYEGYYKNKGVNIIKGTVAVGFDTHPNGEVKEVKLKDGRVLEADIVVVGVGARPLTTLFKGQVEEEKGGIKTDAFFKTSVPDVYAVGDVATF

SEQ ID NO: 1511 - protein, 176 aa, Solanum lycopersicum
EVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSN

SEQ ID NO: 1512 - protein, 101 aa, Zea mays
QKRIVGFFHVEGRHTGQRLSQTFTAIMVKWNIEKKLFALSLDNASANEVAVHDIIEDLQDTDSNLVCDGAFFHVRCACHILNLVAKDGLAVIAGTIEKIKA

SEQ ID NO: 1513 - protein, 101 aa, Solanum lycopersicum
MIERSTNLDWYKGPTLLEALDQINEPKRPSDKPLRLPLQDVYKIGGIGTVPVGRVETGVIKPGMVVTFGPTGLTTEVKSVEMHHEALQEALPGDNVGFNVK

SEQ ID NO: 1514 - protein, 251 aa, Solanum lycopersicum
ELKEKFKRMCDKSMIKKRYMHLTEEILKENPNMCAYMAPSLDARQDIVVVEVPKLGKRGTQKAIKEWGQPKSKITHLVFCTTSGVDMPACDYQLAKLLPVRPSVKRLMMYQQGCFAGGTVLRLAKDLAENNKGARVLVVCSEITAVTFRGPSESHLDSLVGQALFGDGAAAIIIGSDPIIGVERPLFELVSAAQTLVPDSEGAIDGHLREVGLTFHLLKDVPGLISKNIEKSLLEAFQPLGISDWNSLFWI

SEQ ID NO: 1515 - protein, 76 aa, Zea mays
DVDAVVYLMLVNDLIHGLYPEAVTIGEDVSGMPTFALPVHDGGVGFDYRMHMAVADKWIDLLKQSDETWKMGDIVH

SEQ ID NO: 1516 - protein, 276 aa, Oryza sativa
TKVKVEPFNSVKKKMAVLISLPNGTSRWFCKGASEIILQMCDMMVDGDGNAIPLSEAQRKNILDTINSFASDALRTLCLAYKEVDDDIDDNADSPTSGFTLIAIFGIKDPVRPGVKDAVKTCMSAGITVRMVTGDNINTAKAIAKECGILTEDGVAIEGPEFHSKSTEEMRDLILNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIV

SEQ ID NO: 1517 - protein, 76 aa, Solanum lycopersicum
FIMIKPDGVQRGLVGEIISRFEKKGFSLKGLKLITVDRAFAEKHYADLSAKPFFNGLVEYIVSGPVVAMVWEGKGV

SEQ ID NO: 1518 - protein, 176 aa, Oryza sativa
FVADSGNHANAEGFGPKLVSVSISIGGMLVFAMMLGLVTDSISEKFDSLRKGRSEVIEQSHTLVLGWSDKLGSLLNQIAIANESLGGGTIVVMAEKDKEEMEADIAKMEFDLKGTAIICRSGSPLILADLKKVSVSKARAIVVLAEEGNADQSDARALRTVLSLTGVKEGLRGHIV

SEQ ID NO: 1519 - protein, 101 aa, Solanum lycopersicum
IIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDF

SEQ ID NO: 1520 - protein, 151 aa, Zea mays
LAYLKRKVDAGADLIVTQLFYDTDIFLKFVNDCRQIGITCPIVPGIMPINNYKGFLRMTGFCKTKIPSEITAALDPIKDNEEAVRQYGIHLGTEMCKKILATGIKTLHLYTLNMDKSAIGILMNLGLIEESKVSRPLPWRPATNVFRVKED

SEQ ID NO: 1521 - protein, 101 aa, Solanum lycopersicum
SRLEVVGEYHLGEFVNRFRHGSLVMRLPDSDVGQIPTVIFGTVNGVIGVIASLPHDQYLFLEKLQTNLRKVIKGVGGLSHEQWRSFYNEKKTVDAKNFLDG

SEQ ID NO: 1522 - protein, 76 aa, Zea mays
EIKATDIRVLCVRRLVYWTRFFIILTAFSNAQIDAISSKMRDIGEKQFSKVASGDTKPNSWTLLDFGDVVVHIFLP

SEQ ID NO: 1523 - protein, 101 aa, Zea mays
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVV

SEQ ID NO: 1524 - protein, 101 aa, Oryza sativa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVV

SEQ ID NO: 1525 - protein, 101 aa, Oryza sativa; identical to SEQ ID NO: 1524

SEQ ID NO: 1526 - protein, 201 aa, Solanum lycopersicum
DWGPGGGPDLIVDDGGDATLLIHEGVKAEEEFAKNGTVPDPTSTDNVEFQLVLTIIKESLKTDPLRYTKMKERLVGVSEETTTGVKKLYQMPANGSLLFLPINVNDSVTKSKFDNLYGCRHSLPDGLMRATDVMIAGKVALVAGYGDVGKGCAAAMKQAGARVIVTEIDPICALQATMEGLQVLFLEDVVSEVDIFVTTTG

SEQ ID NO: 1527 - protein, 101 aa, Zea mays
SYLKKVGYNPDKIHFVPISGFEGDNMIERSTNLDWYKGPTLLEALDLINEPKRPSDKPLRLPLQDVYKIGGIGTVPVGRVETGVIKPGMVVTFGPTGLTTE

SEQ ID NO: 1528 - protein, 201 aa, Oryza sativa
RKLCGVVKNPKRRFRFTANLDKRGEAQAIKHANHEKLRVAVLVSKAALQFIQGLSLRSEYVVPEEVKAAGFQICADELGSIVEGHDSKKLITHGGVTGIADKLATSPADGLSTAEESIKRRQDVYGLNKFTESEVRSFWVFVWEALQDTTLIILAVCAFVSLVVGIAMEGWPKGAHDGLGIVASILLVVFVTATSDYRQSL

SEQ ID NO: 1529 - protein, 101 aa, Solanum lycopersicum
TRQLDGAHVEFLRGVANPLGIKVSQKMDPKELIKLIDILNPANKPGRITVIVRMGAENMRVKLSHLVRAVRGAGQIVTWVCDPMHGNTIKAPCGLKTRAFD

SEQ ID NO: 1530 - protein, 151 aa, Zea mays
MTKDETLLVFTLVVSSVSIFLFGILLFMVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEFVVTFSCRVKKRLYARAIEVGIH

SEQ ID NO: 1531 - protein, 176 aa, Oryza sativa
IVDIALSEDKNIDFKINMFKAHSLFFKFLYAETSEECIVSIVEVLPRILKHSSRDVLLDMKFQWVQCVDFLLLHEMKAVRDAFSSVVSCFLETNAMDILFSDGTGMSGGTSRVKFMDKIKSAFTEAEDPQILLTLLESTAAIVKASDIHGEVFFCSFVLLIGQLGNHDYIVRVTAL

SEQ ID NO: 1532 - protein, 76 aa, Zea mays
DDITRLRLITAVKTPYLPDGRFDLEAYDSLINMQIEGGAEGVIVGGTTGEGHLMSWDEHIMLIGHTVNCFGSRIKV

SEQ ID NO: 1533 - protein, 176 aa, Oryza sativa
CIGIVGIKDPVRPGVRESVATCRSAGIMVRMVTGDNINTAKAIARECGILTEDGLAIEGPEFREKSLDELLKLIPKIQVMARSSPLDKHTLVKHLRTTFNEVVAVTGDGTNDAPALHEADIGLAMGIAGTEVAKESADVIILDDNFSTIVTVAKWGRSVYVNIQKFVQFQLTVNVV

SEQ ID NO: 1534 - protein, 126 aa, Oryza sativa
FGIHEEMLKDVVRTKSYQNVITQNSFLFKDKIVLDVGAGTGILSLFCAKAGAKHVYAIECSQMADMAKEIVKTNGYSNVITVIKGKVEEIELPVPKVDVIISEWMGYFLLFENMLNTVLYARDKWL

SEQ ID NO: 1535 - protein, 226 aa, Solanum lycopersicum
MEEFVDVAIEAAKKAGEIIRHGFYKSKHIEHKGVVDLVTETDKACEVLIFNHLKQCFPSHKFIGEETTAAASGNFELTDEPTWIVDPLDGTTNFVHGFPFVCVSIGLTIEKKPVVGVVYNPIIDELFTAIYGRGAFLNGKSIRVSSESQLVKALVATEVGTNRDKAIVDATTGRINRVIFKVRSLRMSGSCALNLCGVACGRLDLFYEIEFGGPWDVAAGALIVIE

SEQ ID NO: 1536 - protein, 151 aa, Oryza sativa
SDVDAIDEAQRRKILVRVKQYHLPPELIEEGFCISPDELAAIANMREDYTMLRMHGGINGISRKIKASLEDGAKETDIATRQMLYGANRHAEKPPRSFWMFVWDALHDLTLIILVVCALVSIVVGLATKGWPMGIYDGFGIILSILLVVLV

SEQ ID NO: 1537 - protein, 251 aa, Zea mays
VRFRVDDGCVVEGGTVCAESGSWTEIKGVFRLKRNARVMEVYVQGAVAGIDVKVTDPQVFATNVIQNLAYVDFFTKHFDWAVFEKEFRWYHVEDAAKVFDKMLTKGEEAPSVQRGVVMTAVAHNLLVQALFMDGRASDAYVVLEEMQNNGPFPDVFTYTLKVLKNGQWAEEESTILVPGDIIGVKLGDIISADTRLLEGDPLKIDQSALTGNFCICSIVAGMLVEFIVMYPIQDMVYRPRIDKLLVLLIGG

SEQ ID NO: 1538 - protein, 76 aa, Solanum lycopersicum
TVGEACQKYGWIFKRPQGLFFSLKEKGKIHEVLKNWPEKKIQVIVVTDGERILGLGDLGCQGMGIPVGKLSLYSAL

SEQ ID NO: 1539 - protein, 101 aa, Oryza sativa
TSGLFYDCSAHMLWVGERTRQLDGAHVEFLRGVANPLGIKVSDKMNPRDLVKLIEILNPSNKPGRITIITRMGAENMRVKLPHLIRAVRNSGQIVTWITDP

SEQ ID NO: 1540 - protein, 151 aa, Solanum lycopersicum
IVIGSGIGGLVAATQLAVKGAKVLVLEKYVIPGGSSGFYERDGYKFDVGSSVMFGFSDKGNLNLITQALAAVGRKLEVIPDPTTVHFHLPNDLSVRIHREYDDFIEELVSKFPHEKEGIIKFYSECWKIFNSLNSLELKSLEEPIYLFGQF

SEQ ID NO: 1541 - protein, 126 aa, Zea mays
CQNKSYMCVTIHWIDDDWCLQKRIVGFFHVEGRHTGQRLSQTFTAIMVKWNIEKKLFALSLDNASANEVAVHDIIEDLQDTDSNLVCDGAFFHVRCACHILNLVAKDGLAVIAGTIEKIKAIVLAV

SEQ ID NO: 1542 - protein, 176 aa, Zea mays
EKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNL

SEQ ID NO: 1543 - protein, 101 aa, Zea mays
VVNICHFMGVMHRDLKPENFLLATMEENAMLKATDFGLSVFIEEGKMYRDIVGSAYYVAPEVLRRSYGKEIDVWSAGVILYILLSGVPPFWAEIEKGIFDA

SEQ ID NO: 1544 - protein, 176 aa, Oryza sativa
RSLDKAKVRSTQEKIRVALYVQQAALIFSDGAKKKEYKLTGDIIKAGYAINPDELALITSKHDSKALKMHGGVDGISIKVRSSFDHGIYASELDTRQNIYGVNRYAEKPSRSFWMFVWDALQDMTLIILMVCALLSVAVGLATEGWPKGMYDGLGIILSIFLVVMVTAVSDYKQSL

SEQ ID NO: 1545 - protein, 151 aa, Oryza sativa
KIVVGISYAAKIPLKSVALALQGSESDHAQDALRVLDIVLRQQQAKRGCLLVRQSFFSDDFRNLVDLTGGVSGCRGLHSSFRTTIGGLSLNMDVSTTMIVTPGPVFDFLLTNQNVRDIRDIDWPRAKKMLKNLRVKAIHNNMEFKIIGLSD

SEQ ID NO: 1546 - protein, 76 aa, Solanum lycopersicum
KGPNFGTKVSNYPPCPKPDLIKGLRAHTDAGGIILLFQDDKVSGLQLLKDGRWIDVPPMRHSIVVNLGDQLEVITN

SEQ ID NO: 1547 - protein, 76 aa, Zea mays
ERLPLTGVDVVSLDWTVDMAEGRKRLGSNTAVQGNVDPGVLFGSKEFITRRIYDTVQKAGNVGHVLNLGHGIKVGT

SEQ ID NO: 1548 - protein, 201 aa, Zea mays
PAPINGIWAILRNNEMLTWPEKVKFAIGLLPAMVGGQPYVEAQDGLTVSEWMKKQGVPDRVNDEVFIAMSKALNFINPDELSMQCILIALNRFLQEKHGSKMAFLDGNPPERLCMPIVDHIRSRGGEVRLNSRIKKIELNPDGTVKHFALSDGTQITGDAYVCATPVDIFKLLVPQEWSEITYFKKLEKLVGVPVINVHIW

SEQ ID NO: 1549 - protein, 126 aa, Zea mays
IKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNS

SEQ ID NO: 1550 - protein, 126 aa, Solanum lycopersicum
LPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPF

SEQ ID NO: 1551 - protein, 126 aa, Zea mays
TLAIIHLGQFICENLCLFKLHIKKSGQIFIVNMDSFVLRAAKPYLATIGATVHGHYGKILYKGDRLVTFIYEKSRSSDITQGLPKVEQIFEARSIDSLSPNLERRIEDWNERIPRILGVPWGFLIG

SEQ ID NO: 1552 - protein, 76 aa, Oryza sativa
DGIWTWHRMNRLFNWLPLAALIEKKIICMHGGIGRSINHVEQIENLQRPITMEAGSVVLMDLLWSDPTENDSVEGL

SEQ ID NO: 1553 - protein, 101 aa, Zea mays
VPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFL

SEQ ID NO: 1554 - protein, 101 aa, Oryza sativa
GVNRYAEKPSRSFWMFVWDALQDMTLIILMVCALLSVAVGLATEGWPKGMYDGLGIILSIFLVVMVTAVSDYKQSLQFKELDNEKKKIFIHVTRDGRRQKI

SEQ ID NO: 1555 - protein, 151 aa, Oryza sativa
AYSHIGVHEEMLKDHVRTNTYRNAIMHHQDLISGKVVLDVGCGTGVLSIFCAFAGAARVYAVDASDIALQAMEIVRENELSDKVIVLHGRIEDVEIEEKVDVIISEWMGYMLLYESMLGSVIFARDKWLKPGGLILPSHASLYLAPITNSH

SEQ ID NO: 1556 - protein, 76 aa, Zea mays
ECAKGRQLRFLANVDPVDVARSIKDLDPETTLVVVVSKTFTTAETMLNARTLKEWIVSSLGPQAVAKHMIAVSTNL

SEQ ID NO: 1557 - protein, 176 aa, Oryza sativa
LIAIFGIKDPVRPGVKDAVKTCMSAGITVRMVTGDNINTAKAIAKECGILTEDGVAIEGPEFHSKSTEEMRDLILNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIV

SEQ ID NO: 1558 - protein, 76 aa, Solanum lycopersicum
AHTDAGGIILLFQDDKVSGLQLLKDEQWIDVPPMRHSIVVNLGDQLEVITNGKYKSVMHRVIAQTDGTRMSLASFY

SEQ ID NO: 1559 - protein, 76 aa, Solanum lycopersicum
AHTDAGGIILLFQDDKVSGLQLLKDEQWIDVPPMRHSIVVNLGDQLEVITNGKYKSVLHRVIAQTDGTRMSLASFY

SEQ ID NO: 1560 - protein, 126 aa, Zea mays
RDMGIGKDGVLPWKLPGDLKFFKELTLTTSDPVKKNAVIMGRKTWESIPVKSRPLPGRLNVILTRSGSFDFATVENVVICGSMESALELLASTPYCLSIEKVFVIGGGQVLREYLKGPACEAIHLT

SEQ ID NO: 1561 - protein, 76 aa, Oryza sativa
KVMQGYAYILTHPGIPCIFYDHVFDWNLQHEIATLAEIRSRNGIHAESTLDILKAEGDIYVAMIDGKVITKLGPRY

SEQ ID NO: 1562 - protein, 126 aa, Solanum lycopersicum
MSLGGIVDAILGKDDRPKVKGRVILMKKNVLDFINIGASVVDGISDLLGQKVSIQLISGSVNYDGLEGKLSNPAYLESWLTDITPITAGESTFSVTFDWDRDEFGVPGAFIIKNLHLNEFFLKSLT

SEQ ID NO: 1563 - protein, 101 aa, Oryza sativa
DEQVADNIIGVLFAAQDTTASVLTWIVKYLHDHPKLLEAVRAEQAAIRAANDGGRLPLTWAQTRSMALTHKVILESLRMASIISFTFREAVADVEYKGFLI

SEQ ID NO: 1564 - protein, 176 aa, Oryza sativa
FVWDALHDLTLIILVVCALVSIVVGLATKGWPMGIYDGFGIILSILLVVLVTATSDYQQARKFMELDREKQKIYIRVTRDKKTKEVLVHDLVVGDILHLSIGDVVPADGLFISGDCLMIDESSLSGESEPVNISEERPFLHAGNKVVDGAAKMLVTAVGTRTEWGKIMGTLNGDGV

SEQ ID NO: 1565 - protein, 76 aa, Oryza sativa
YEGVFVKVCEITLSVLRTHKEALMTVLETFIHDPLVEWTKSHKSSGVEVRNPHAQRAISNITERLQGVVVGVNAAP

SEQ ID NO: 1566 - protein, 201 aa, Oryza sativa
GVNRYAEKPSRSFWMFVWDALQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPADGLYIHGYSLLIDESSLSGESDPVYVSQDKPFILAGTKVQDGSAKMIVTAVGMRTEWGKLMSTLSEGGEDETPLQVKLN

SEQ ID NO: 1567 - protein, 126 aa, Zea mays
VDIDGDGSFLMNIQELAMIRIENLPVKVFVLNNQHLGMVVQWEDRFYKANRAHTFLGNPENESEIYPDFVAIAKGFNIPAVRVTKKSEVHAAIKKMLEAPGPYLLDIIVPHQEHVLPMIPSGGAFK

SEQ ID NO: 1568 - protein, 201 aa, Solanum lycopersicum
TITGIQESVHEILMNLKEIVLRSNLYGTSEASICVKGPGYVTAQDIILPPYVEIVDNTQHIASLTEPIDFCIGLQIERNRGYLIKTPHNFQDGSYPIDAVFMPVRNANHSIHSYGNGNEKQEILFIEIWTNGSLTPKEALHDASRNLIDLFIPFLHMEEDNLYLQDNQHTVPLSPFTFHDKLAKLIKNKKKIALKSIFIDQ

SEQ ID NO: 1569 - protein, 126 aa, Zea mays
VIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHV

SEQ ID NO: 1570 - protein, 201 aa, Solanum lycopersicum
WNKCIPRILGIPWGFLIGAELTIAQSRISLVNKIQQVYRSQGVQIHNRHIEIIVRQITSKVLISEDGMSNVFSPGELIGLLRAERMGRALEEAICYRVVLLGITRASLNTQSFISEASFQETARVLAKAALRGRIDWLKGLKENVVLGGVIPVGTGFKGLVHPSKQHNNIPLETKKTNLFEGEMRDILFHHRKLFDSCLSK

SEQ ID NO: 1571 - protein, 201 aa, Oryza sativa
DKLATSPADGLSTAEESIKRRQDVYGLNKFTESEVRSFWVFVWEALQDTTLIILAVCAFVSLVVGIAMEGWPKGAHDGLGIVASILLVVFVTATSDYRQSLQFKDLDKEKKKIQVQVTRNGFRQRLSIYDLLPGDVVHLAIGDQVPADGLFISGFSLLINESSLTGESEPVVVNEDNPFLLSGTKVQDGSCKMLITTVGMR

SEQ ID NO: 1572 - protein, 101 aa, Oryza sativa
IVRRGVSKSEEKTQVAIKTLRRLGPAMAGMKQGTKPVPGSGLPMWKQVSISDALLTNEILVMRRIVESVAPHPNVINLHDVYEDVHGVHLVLELCSGGELF

SEQ ID NO: 1573 - protein, 201 aa, Oryza sativa
LCVLPMFHVYSLHSILLCGMRAGAAIVVMKRFDTVKMLQLVERHGVTIAPLVPPIVVEMAKSDALDRHDLSSIRMVISGAAPMGKELQDIVHAKLPNAVLGQGYGMTEAGPVLSMCMAFAKEPTPVKSGACGTVVRNAELKIVDPDTGLSLPRNQPGEICIRGKQIMKGYLNNPEATEKTIDKDGWLHTGDIGFVDDDDEI

SEQ ID NO: 1574 - protein, 176 aa, Solanum lycopersicum
PINVNDSVTKSKFDNLYGCRHSLPDGLMRATDVMIAGKVALVAGYGDVGKGCAAAMKQAGARVIVTEIDPICALQATMEGLQVLFLEDVVSEVDIFVTTTGNKDIIMVDHMRKMKNNAIVCNIGHFDNEIDMHGLETFPGVKRITIKPQTDRWVFPDTNSGIIVLAEGRLMNLGCA

SEQ ID NO: 1575 - protein, 151 aa, Oryza sativa
CKRLLPAAGDGHILVMNDKSLQFACKLCNYYDPTKIIACTPGPHSFESDSVTKGLKILQNLADPSYLFIGGEHKLSVPWTKLSRVFWFADIDSNESISEQVVLQKFFQHIAIKTLSEKMSDLQVIVIMNNAKFVQLQVERLARECFLFLGE

SEQ ID NO: 1576 - protein, 276 aa, Solanum lycopersicum
AIGDEKRLMQILLNVVGNAVKFSKEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVL

SEQ ID NO: 1577 - protein, 126 aa, Solanum lycopersicum
ICIVVNTGMCTEIGKIQRQIHDASMEESDTPLKKKLDEFGNRLTFAIGVVCLVVWAINYKYFLSWEVVDDWPSDFRFSFEKCAYYFKIAVALAVAAIPEGLPSVITTCLALGTRKMAQKNAIVRKL

SEQ ID NO: 1578 - protein, 151 aa, Zea mays
IQPARRHTKNTNMAKHTTKGTGHSMFISPRKIAHIPQINCEKQKLVLEVRSIYNDSWRVRGVLPFMINDFINQLNLTGKYRFGPVVYYQINIKEIPPLIYDVIRMEASKGYLWLDERNLDTHSLIGVYKCRVPMDLLVLKGLSNVILTTVN

SEQ ID NO: 1579 - protein, 76 aa, Oryza sativa
DKVMQGYAYILTHPGVPCIFYDHVFDWNLKQEISTLAAVRSRNGIHPGSKLNILAADGDVYVAMIDDKVITKIGTR

SEQ ID NO: 1580 - protein, 201 aa, Solanum lycopersicum
EVPKLGKEAAQKAIKEWGQPKSKITHVVFCTTSGVDMPGADYQLTKLLGLRPSVKRLMMYQQGCFAGGTVIRLAKDLAENNKGARVLVVCSEITAVTFRGPSDTHLDSMVGQALFGDRAAAMIIGSDPLPEVERPLFELVSAAQTLLPDSEGAIDGHLREVGLTFHLLKDVPGLISKNIEKSLIEAFQPLGISDWNSIFWI

SEQ ID NO: 1581 - protein, 126 aa, Zea mays
QKFTKQYGLYYNLVEWIIDLPIYDFHNHSFFPSTGITPIGEITHVILHNFYQNTVDSLLESWYPGITYSRYGHELFILCKQTDEFTIDDCDIDNILEVLDLYSVDINWSSDGLLMADNNDKALILH

SEQ ID NO: 1582 - protein, 101 aa, Oryza sativa
ILADWIIEVHHKFELMPETLYLSMYVIDRYLSMQQVQRRELQLVGVSAMLIACKYEEIWAPEVNDFILISDSAYTREQILAMEKGILNKLQWNLTVPTAYV

SEQ ID NO: 1583 - protein, 201 aa, Oryza sativa
NIYGVNRYAEKPSRSFWMFVWDAFQDMTLIILMVCALLSVAVGLATEGWPKGMYDGLGIILSIFLVVMVTAVSDYKQSLQFKELDNEKKKIFIHVTRDGRRQKISIYDLVVGDIVHLSIGDQVPADGLYIHGYSLLIDESSLSGESDPVYVSQDKPFILAGTKVQDGSAKMIVTAVGMRTEWGKLMSTLSEGGEDETPLQV

SEQ ID NO: 1584 - protein, 76 aa, Oryza sativa
PVSGVRIPYQEKRMFGFVSFLYTETVRLILSKGTAHFICGLRVLVKRYMEKSELRMTWLKSVSGSQVDSCLKVTIG

SEQ ID NO: 1585 - protein, 126 aa, Solanum lycopersicum
MRGHQFKSWIFELREILREIKNSHHFLDSWTQFNSVGSFIHIFFHQERFLKLFDPRIWSILLSRNSQGSPSNRYFTIKGVILFVVAVLIYRINNRNMVERKNLYLIGLLPIPMNSIGPRNDTLEES

SEQ ID NO: 1586 - protein, 201 aa, Zea mays
QLSVSGQNWGGIDIDGNMLTFMVGSKQAFEVSLPDVAQTQMQGKTDVLLELHVDDTTGANEKDSLMDLSFHVPTSNTQFVGDESRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKE

SEQ ID NO: 1587 - protein, 101 aa, Oryza sativa
GSAGTICTDKTGTLTTNYMVVDKIWISEVSKSVTSNTISGELNSVVSSRTLSLLLQGIFENTSAEVVKEKDGKQTVLGTPTERAILEFGLGLEGVHDAEYS

SEQ ID NO: 1588 - protein, 276 aa, Solanum lycopersicum
KFAERGLRSLGVAYQEVPEGRKESSGGPWQFIGLLPLFDPPRHDSAETIRRALNLGVNVKMITGDQLAIGKETGRRLGMGTNMYPSSALLGQTKDESIASLPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMT

SEQ ID NO: 1589 - protein, 226 aa, Solanum lycopersicum
ESFFTQLYSVTLASSGELICKDFFLYMESNQFGLFATSTAQIHDAPPTGGAIQGVPSVEKITFHLLRLVDGAILDERVFHNDYVNLAHSIGAFLYDDLLAIVSLRYQRIHILQIRDSGDLVDVRAIGEFCREDDELFLNSNSQVLVNHVGNGFHHSLPQSETSFLSGIKQRLLSYIFRGIWNEADQTMRVQCLKKKFYFHFQDYIDLIIWKVQFLDRHHLLIKFGS

SEQ ID NO: 1590 - protein, 101 aa, Oryza sativa
NIYGVNRYAEKPSRSFWMFVWDAFQDMTLIILMVCALLSVAVGLATEGWPKGMYDGLGIILSIFLVVMVTAVSDYKQSLQFKELDNEKKKIFIHVTRDGRR

SEQ ID NO: 1591 - protein, 151 aa, Zea mays
STSTFANFIHQKDAFTAIQLVDFINKLENASSIPIYAVHDNFITMPEYASILPTLYRDSIFRMGHPLIIINKFLFDHILIPAIQNEHPQNKHLFSVEERSMLDRMMIDLQNPLIPDFGSVDITKARIKSIVIPKDLLLKCFSCLWMSKTKK

SEQ ID NO: 1592 - protein, 76 aa, Oryza sativa
VIKSIEKILVHGEYVDTNYSDKVTVTKYTLDSTSACFINNRNDNMDVNVTLDGTTHLLPAWSVSILPDCKTVAFNS

SEQ ID NO: 1593 - protein, 126 aa, Solanum lycopersicum
FVSKILAEKAAMEEARKNNIDFISIIPPLVVGPFITSTFPPSLITALSLITAHYGIIKQGQYVHLDDLCEAHIFLYEHPKAEGRFICSSHHAIIYDVAKMVRQKWPEYYVPTEFKGIDKDLALVSF

SEQ ID NO: 1594 - protein, 276 aa, Oryza sativa
DFFALPLFAVFFLVVRYLLDCFVFEWIGRKLIFGKEKVDYEKEETRKKIRKFKESAWKCVYFLSGEILSLSVTYNEPWFTNTKYFWVGPGDQVWPDQKIKWKLKAVYMYAAGFYTYSIFALMFWETRRSDFGVSMSHHVATVALIVLSYVFRFARVGSVVLAIHDASDVFLEVGKMAKYSHCDLLANVAFLLFVVSWVLLRLTYFPFWILRSTSYEVLLTLDKKKHNFDGPIYYYVFNSLLFSLLVLHIYWWVLIYRMLVRQIKTRNVGDDVRSDS

SEQ ID NO: 1595 - protein, 151 aa, Oryza sativa
RILPAPWLKFHDSGETTEFLPQLGIWNMMHKKMINGGRVKSWACVNFCWSVREYAARNFCYDLGFMCRESGMVFSVKPVLPLVIAKPGCVESALRTLHDDVMDILRPQGRKLDLLIVILPNNNGSLYGDVKRICETDIGLISQCCLAKHVL

SEQ ID NO: 1596 - protein, 176 aa, Solanum lycopersicum
AVGMWTDISVRIYSLPDLNLITKEQLGGEIIPRSVLMCSFEGISYLLCALGDGHLLNFVLSMSTGELTDRKKVSLGTQPITLRTFSSKDTTHVFAASDRPTVIYSSNKKLLYSNVNLKEVSHMCPFNVAAFPDSLAIAKEGELTIGTIDEIQKLHIRSIPLGEHARRISHQEQTRT

SEQ ID NO: 1597 - protein, 151 aa, Solanum lycopersicum
CEDLIFNHLKQHFPSHKFIGEETSAATGDFDLTDEPTWIVDPVDGTTNFVHGFPSVCVSIGLTIGKIPTVGVVYDPIIDELFTGINGKGAYLNGKPIKVSSQSELVKSLLGTEVGTTRDNLTVETTTRRINNLLFKVRSLRMCGSCALDLC

SEQ ID NO: 1598 - protein, 76 aa, Zea mays
DAGTSNVTVTVSDKDVLLEVQCRWEELLMTRVFDAIKSLHLDVLSVQASAPDGFMGLKIRAQFAGSGAVVPWMISE

SEQ ID NO: 1599 - protein, 176 aa, Oryza sativa
SGMYDGVGIMLTILLVVMITAASDYKQSLQFRDLDKEKKKIDVQVTRDGYRQKVSIYDIVVGDIVHLSIGDQVPADGLFIDGYSFVVDESNLSGESEPVHVSTANRFLLGGTKVQDGSARMLVTAVGMRTEWGNLMETLSQGGEDETPLQVKLNGVATIIGKIGLAFAVLTFTVLM

SEQ ID NO: 1600 - protein, 176 aa, Zea mays
RMASTPGVSATLFDALAKANINVRAIAQGCSEYNITIVLKQEDCVRALRAAHSRFFLSKTTLAVGIIGPGLIGRTLLNQLKDQAAVLKENMNIDLRVMGIAGSRTMLLSDIGVDLTQWKEKLQTEAEPANLDKFVHHLSENHFFPNRVLVDCTADTSVASHYYDWLKKGIHVITPN

SEQ ID NO: 1601 - protein, 201 aa, Oryza sativa
TQMGLQLNIDVSSSVFIKPVPVVDYVAQLLNEDILLDRPLCSTEFLKIKEALEGLKVQINGILFNTYHVQDLVHQAASFPVNFSIQYPSLPCLKVAHFGETIFLPLEVCKIAEGQCHQKQLNAKHMAALLQVARQPPNERDYNILQTVHQNKYQEDPHAKEFGIKIEEKLVSIKSRILPAPWLKFHDSGETTEFLPQLGIW

SEQ ID NO: 1602 - protein, 126 aa, Solanum lycopersicum
MAKKKAFTPLFYLASIVFLPWWISFSVNKWLESWVTNWWNTGQSQIVLNNIQEKSLLEKFRELEELLFLDEMIKEYSETHLEEFGIGIHKETIQLITIQNENRMDTILHFSTNIIWFGILSGYSIL

SEQ ID NO: 1603 - protein, 126 aa, Oryza sativa
CCLTKHVFKMSKQYLANVALKINVKVGGRNTVLVDALTRRIPLVSDRPTIIFGADVTHPHPGEDSSPSIAAVVASQDWPEVTKYAGLVSAQAHRQELIQDLFKVWQDPHRGTVTGGMIKELLISFK

SEQ ID NO: 1604 - protein, 276 aa, Oryza sativa
FSVSAEELASIVRGHDTKSLRFHNGVDGIARKVAVSLADGVKSDDAGLRAEVYGANQYTEKPPRTFWMFLWDASQDMTLLLLAFCAAVSVAIGLATEGWPSGMYDGVGIMLTILLVVMITAASDYKQSLQFRDLDKEKKKIDVQVTRDGYRQKVSIYDIVVGDIVHLSIGDQVPADGLFIDGYSFVVDESNLSGESEPVHVSTANRFLLGGTKVQDGSARMLVTAVGMRTEWGNLMETLSQGGEDETPLQVKLNGVATIIGKIGLAFAVLTFTVLM

SEQ ID NO: 1605 - protein, 226 aa, Solanum lycopersicum
SAGGPWQFIALLPLFDPPRHDSAETIRRALNLGVNVKMITGDQLAIGKETGRRLGMGTNMYPSSALLGQTKDESIAALPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKP

SEQ ID NO: 1606 - protein, 276 aa, Solanum lycopersicum
LDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHG

SEQ ID NO: 1607 - protein, 276 aa, Solanum lycopersicum
AALMARLAPKAKVLRDGKWDEEDASVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKALIEVFAKGIDADTVVLMAARASRIENQDAIDTAIVGMLADPKEARAGIREIHF

SEQ ID NO: 1608 - protein, 151 aa, Oryza sativa
WFHPKSVEEFHRLFDSNLFDERSVKIVASNTGSGVYKDQDLHDKYINISQILELSAINRSSKGVEIGAVVSISKAIEILSDGGAVFRKIADHLSKVASSFVQNTATIGGNIIMAQRLSFPSDIATVLLAAGSTVTIQVAAKRMCITLEEFL

SEQ ID NO: 1609 - protein, 126 aa, Zea mays
LSWTIDQVDSSPLLVAAGSNRIIRVINCATEKLDKSLVGHGGSIHEIRTHASKPSLIISASKDESIRLWNVHTGICILVFAGAGGHRHDVLSVDFHPTEVGIFASCGMDNTVKIWSMKEFWIYVEK

SEQ ID NO: 1610 - protein, 251 aa, Zea mays
IQPARRHTKNTNMAKHTTKGTGHSMFISPRKIAHIPQINCEKQKLVLEVRSIYNDSWRVRGVLPFMINDFINQLNLTGKYRFGPVVYYQINIKEIPPLIYDVIRMEASKGYLWLDERNLDTHSLIGVYKCRVPMDLLVLKGLSNVILTTVNKAQPNISKFKDLKAMHYAFLNRQENVVKVVSIDLSDCMDYIPTSRILTSQKFTKQYGLYYNLVEWIIDLPIYDFHNHSFFPSTGITPIGEITHVILHNFY

SEQ ID NO: 1611 - protein, 101 aa, Solanum lycopersicum
HLEKKMFHTNGFGSITMGSNARDLVALTNEVLSISITQKKSIIDTNTIRSALHRQTWDLRSQVRSVQDHGILFYQIGRAVAQNVLLSNCPIDPISIYMKKK

SEQ ID NO: 1612 - protein, 201 aa, Solanum lycopersicum
LQFELAKAMSPCIIWIPNIHDLDVNESNDLSLGLLVNHLSRDCERCSTRNILVIASTHIPQKVDPALIAPNKLNTCIKIRRLLIPQQRKHFFTLSYTRGFHLEKKMFHTNGFGSITMGSNARDLVALTNEVLSISITQKKSIIDTNTIRSALHRQTWDLRSQVRSVQDHGILFYQIGRAVAQNVLLSNCPIDPISIYMKKK

SEQ ID NO: 1613 - protein, 276 aa, Oryza sativa
RTQWGKLMATLSEGGDDETPLQVKLNGVATIIGKIGLFFAVITFIVLSQGLISKKYHEGLLLSWSGDDALEMLEHFAIAVTIVVVAVPEGLPLAVTLSLAFAMKKMMNDKALVRHLAACETMGSATTICSDKTGTLTTNHMTVVKACICGNIKEVNNPKNASDLCSELPETVVKTLLESIFNNTGGEVVIDQDGKYQILGTPTETALLEFALSLGGNFKAKRDETKIVKMEPFNSTKKRMCVVLKLPGGGCRAHCKGASEIVLAACDKFMDETGAV

SEQ ID NO: 1614 - protein, 101 aa, Oryza sativa
KRICETDLGLVSQCCLTKHVFKMSKQYLANVALKINVKVGGRNTVLVDALTRRIPLVSDRPTIIFGADVTHPHPGEDSSPSIAAVVASQDWPEVTKYAGLV

SEQ ID NO: 1615 - protein, 251 aa, Oryza sativa
ALRTLCLAYKEVDDDIDDNADSPTSGFTLIAIFGIKDPVRPGVKDAVKTCMSAGITVRMVTGDNINTAKAIAKECGILTEDGVAIEGPEFHSKSPEEMRDLIPNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDEMM

SEQ ID NO: 1616 - protein, 176 aa, Zea mays
DVIRMEASKGYLWLDERNLDTHSLIGVYKCRVPMDLLVLKGLSNVILTTVNKAQPNISKFKDLKAMHYAFLNRQENVVKVVSIDLSDCMDYIPTSRILTSQKFTKQYGLYYNLVEWIIDLPIYDFHNHSFFPSTGITPIGEITHVILHNFYQNTVDSLLESWYPGITYSRYGHELF

SEQ ID NO: 1617 - protein, 151 aa, Oryza sativa
VDARRRQEDKKIASGVGPVPPSSTGSLTTATEEKPWWDMLPVVLIQYARGLHRGHKNLFQALPRLLTLWFEFGSIYIQDGSSFNKPMKEVHIRLLGIMRGCLKDLPPYQWLTVLSQLISRICHQNIEVVKLVKCIVTSILREYPQQALWMM

SEQ ID NO: 1618 - protein, 276 aa, Oryza sativa
VLTFLVLLARFLADKGMHVGLLNWSANDALTIVNYFAIAVTIIVVAVPEGLPLAVTLSLAFAMKKLMHDKALVRHLAACETMGSASCICTDKTGTLTTNHMIVDKVWIGDVKFVGDKKNSELKSTISERVMAILIQGIFVNTASEVVKGDDGKNTILGLATETALLEFGLSLEEHLYDDYNKLTRIKVDPFNSVKKKMSVTIQLPNGGIRTFCKGASEIILEQCNTIHNTDGNIVPLSEMQKHNVLNIINSFASEALRTLCIAFKDMDEFPNDQPI

SEQ ID NO: 1619 - protein, 76 aa, Oryza sativa
IHETTYNSIMKCDVDIRKDLYGNIVLSGGSTMFPGIADRMSKEITALAPSSMKIKVVAPPERKYSVWIGGSILASL

SEQ ID NO: 1620 - protein, 76 aa, Oryza sativa
IHETTYNSIMKCDVDIRKDLYGNIVLSGGTTMFPGIADRMSKEITALAPSSMKIKVVAPPERKYSVWIGGSILASL

SEQ ID NO: 1621 - protein, 76 aa, Oryza sativa; identical to SEQ ID NO: 1620

SEQ ID NO: 1622 - protein, 126 aa, Zea mays
KMLTKGEEAPSVQRGVVMTAVAHNLLVQALFMDGRASDAYVVLEEMQNNGPFPDVFTYTLKVLKNGQWAEEESTILVPGDIIGVKLGDIISADTRLLEGDPLKIDQSALTGNFCICSIVAGMLVEF

SEQ ID NO: 1623 - protein, 151 aa, Oryza sativa
ALSTMFPQIYHFTVEESSAMPSLFSRYGVRGFPAILLVNETTMVRYWGPKDLSSLVDFYKETTGFDPIAYFDVDHQDSTGDFRPVTPGDRSLRKIAKDEPFVLLAVLFIILKVAAHFVPIVVSHLKTFLVVRVQNLNLGIRRGSSQLLERA

SEQ ID NO: 1624 - protein, 151 aa, Solanum lycopersicum
AVKQNYGEKVLIQFEDFANHNAFNLLAKYGTSHLVFNDDIQGTASVVLAGLMAALNLVGGSLSEHTFLFLGAGEAGTGIAELIALEMSKQTGIPLEETRKKIWMVDSKGLIVKSRMEMLQHFKRPWAHDHEPVQELVNAVKSIKPTVLIGS

SEQ ID NO: 1625 - protein, 76 aa, Solanum lycopersicum
DVIGISGNFCSDKKPAAVNWIEGRGKSVVCEAIITEEVVKKVLKTEVAALVELNMLKNLTGSAMAGALGGFNAHAS

SEQ ID NO: 1626 - protein, 201 aa, Oryza sativa
DVLKNRLDSLHAAFHGAVDSTGYASRYQGVFPIKVNQNKAVVQDLVTFGHGYSYGLEAGSKPELLIAMSCLAKAKPGAYLVCNGYKDADYVALALSARAMGLNAIIVLEMEEELDIVVEQSARLGVEPVIGVRAKLLTKIPGHFGSTAGKHGKFGMLADKIYEVAGKLKKMGKLHWLKLLHYHVGSMIPTTDIVYNAAAEA

SEQ ID NO: 1627 - protein, 251 aa, Solanum lycopersicum
VFENLRCTREGLTATAAQERLSIFGYNKLEEKKESKFLKFLGFMWNPLSWVMEAAAIMAIALANGGGKPPDWQDFVGIITLLIINSTISFIEENNAGNAAAALMARLAPKAKVLRDGKWDEEDASVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRP

SEQ ID NO: 1628 - protein, 176 aa, Solanum lycopersicum
RVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHG

SEQ ID NO: 1629 - protein, 276 aa, Solanum lycopersicum
SIDYRSVGSGPGSSYVPTKTTAVSAAAALMGVLVVYMGTKAATMVAAAASAALLVVLITFLWGRCSDGFFTKSRTLELEVEPQYAGARIEGDVVTLDFVKKMLDDFKNQKNLHKRYAYQIVLQTREMLRALPSLVDIVVPEGKHFTVCGDVHGQFYDLLNIFELNGLPSEDNPYLFNGDFVDRGSFSLEVILTLFAFKCMCPSAIHLARGNHESKSMNKIYGFEGEVRSKLSEIFVELFAEVFCCLPLAHVINEKVFVVHGGLFSVDGVKLSDIRA

SEQ ID NO: 1630 - protein, 151 aa, Oryza sativa
MAAATVGVLLRLLLLPVVVVVSLLVGASRAANVTYDHRAVVIDGVRRVLVSGSIHYPRSTPDMWPGLIQKSKDGGLDVIETYVFWDIHEAVRGQYDFEGRKDLVRFVKAVADAGLYVHLRIGPYVCAEWNYGGFPVWLHFVPGIKFRTDNE

SEQ ID NO: 1631 - protein, 101 aa, Oryza sativa
RSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFT

SEQ ID NO: 1632 - protein, 76 aa, Oryza sativa
VSGVEAKIVDIKTLKHLPPNQVGEICVRGPNVMQGYFNNVQATEFTIKQGWLHTGDLGYFDGGGQLFVVDRLKELI

SEQ ID NO: 1633 - protein, 251 aa, Solanum lycopersicum
MATPLQPFLTKTHKQNPIIGFNILTFVVTLFVALFLVVFLVAPYQFEIKHSNLCKTAQDSQLCLSYVSEIVTTESDGVTVLKKFLVKYVHQMNNAIPVVRKIKNQINDIRQQGALTDCLELLDQSVDLVSDSIAAIDKRSRSEHANAQSWLSGVLTNHVTCLDELTSFSLSTKNGTVLDELITRAKVALAMLASVTTPNDEVLRQGLGKMPYWVSSRDRKLMESSGKDIIANRVVAQDGTGDYQTLAEAVA

SEQ ID NO: 1634 - protein, 251 aa, Oryza sativa
QGYTCIGIVGIKDPVRPGVRQSVATCRSAGISVRMITGDNIDTAKAIARECGILTKDGIAIEGAEFREKSAEELHDLIPKMQVLARSSPLDKHTLVKHLRTAFNEVVAVTGDGTNDAPALREADIGLAMGIAGTEVAKESADVVILDDNFSTIVTVAKWGRSVYVNIQKFVQFQLTVNVVALLVNFTSACFTGDAPLTAVQLLWVNMIMDTLGALALATEPPNNNLMKKAPVGRKGKFITNVMWRNIVGQS

SEQ ID NO: 1635 - protein, 76 aa, Oryza sativa
IKLGGSHSAQVLLARDTRPTGEYLLDVAVKGVNAVIGAVAVDMGILTTPQLHWMVRSKNKGLKSSETDYFSQVIDS

SEQ ID NO: 1636 - protein, 226 aa, Oryza sativa
MGVPPVDWEAESYPAYSDFAAIPLFAVFLFAVRYLLDRFVFEWLARRLIFEKDEKLDLATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQLLADVSFLIFVCSWAVLRLIYYPFW

SEQ ID NO: 1637 - protein, 101 aa, Solanum lycopersicum
IVKRLQARKHICGMTGDGVNDAPALKKADIGIAVDDATDAARSASDIVLTEPGLSVIISAVLTSRAIFQRMKNYTIYAVSITIRIVLGFMLLALIWKFDFP

SEQ ID NO: 1638 - protein, 76 aa, Oryza sativa
CTKQVFKMNKQILANLALKINVKVGGRNTVLVDAVSRRIPLVTDRPTIIFGADVTHPHPGEDSSPSIAAVVASQDW

SEQ ID NO: 1639 - protein, 276 aa, Oryza sativa
CIGIVGIKDPVRPGVRESVATCRSAGIMVRMVTGDNINTAKAIARECGILTEDGLAIEGPEFREKSLDELLKLIPKIQVMARSSPLDKHTLVKHLRTTFNEVVAVTGDGTNDAPALHEADIGLAMGIAGTEVAKESADVIILDDNFSTIVTVAKWGRSVYVNIQKFVQFQLTVNVVALLVNFSSACFTGNAPLTAVQLLWVNMIMDTLGALALATEPPNDDLMKREPVGRTGKFITNVMWRNILGQSFYQFIVMWYLQTQGKSMFGLDGPDAEVVL

SEQ ID NO: 1640 - protein, 76 aa, Zea mays
TMDAGSSNVTVTVSDKDVLLEVQCRWEELLMTRVFDAIKSLHLDVLSVQASAPDGFMGLKIRAQFAGSGAVVPWMI

SEQ ID NO: 1641 - protein, 226 aa, Oryza sativa
ISDDGYTLIAVFGIKDPVRPGVKDAVRTCMAAGIRVRMVTGDNINTAKAIAKECGILTEDGIAIEGQQLNNKSSDELKELLPKIQVIARSLPMDKYKLVTSLKSMYQEVVAVTGDGTNDAPALHESDIGLAMGITGTEVAKESADVIIMDDNFETIVNVARWGRAVYLNIQKFVQFQLTVNIVALIVNFVSACIIGSAPLTAVQLLWVNMIMDTLGALALATEPPN

SEQ ID NO: 1642 - protein, 201 aa, Oryza sativa
HIFGLSVITYAQLHRGNAIIAMSRFDINSLMEAVQRHRVTHLFCVPPVIIALAKHGKAGKYDLSSLKFIGSGAAPLGKDVMEVVAKKFPDSEIVQGYGMTETCGIISLEYPEKGQAREFGSTGTLVSGVEAKIVDIKTLKHLPPNQVGEICVRGPNVMQGYFNNVQATEFTIKQGWLHTGDLGYFDGGGQLFVVDRLKELI

SEQ ID NO: 1643 - protein, 101 aa, Oryza sativa
DKLATSPADGLSTAEESIKRRQDVYGLNKFTESEVRSFWVFVWEALQDTTLIILAVCAFVSLVVGIAMEGWPKGAHDGLGIVASILLVVFVTATSDYRQSL

SEQ ID NO: 1644 - protein, 76 aa, Solanum lycopersicum
IAIELFQTFVIRGLIRQHLASNIGVAKSKIREKEPIVWEILQEVMQGHPVLLNRAPTLHRLGIQAFQPVLVEGRAI

SEQ ID NO: 1645 - protein, 76 aa, Zea mays
ISSLVDVGGGIGAAAQAISKAFPHVKCSVLDLAHVVAKAPTHTDVQFIAGDMFESIPPADAVLLKSVLHDWDHDDC

SEQ ID NO: 1646 - protein, 101 aa, Oryza sativa
IGDVVPADGLFISGDCLMIDESSLSGESEPVNISEERPFLHAGNKVVDGAAKMLVTAVGTRTEWGKIMGTLNGDGVDETPLQVKLNGVATIIGQIGLVFAV

SEQ ID NO: 1647 - protein, 276 aa, Oryza sativa
LIAIFGIKDPVRPGVKDAVKTCMSAGITVRMVTGDNINTAKAIAKECGILTEDGVAIEGPEFHSKSTEEMRDLILNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIVALVINFVSACIIGSAPLTAVQLLWVNMIMDTLGALALATEPPNDEMMKRPPVRKGESFITKFMWRNIMGQSLYQLFVLGALMFGGERLLNIKGADSKSII

SEQ ID NO: 1648 - protein, 226 aa, Zea mays
KMLTKGEEAPSVQRGVVMTAVAHNLLVQALFMDGRASDAYVVLEEMQNNGPFPDVFTYTLKVLKNGQWAEEESTILVPGDIIGVKLGDIISADTRLLEGDPLKIDQSALTGNFCICSIVAGMLVEFIVMYPIQDMVYRPRIDKLLVLLIGGIPIAMPTVLSVTMSIGAYRLAQQGAITKRMTTIEEMAGMDVPCSDKTGTLPWTKLTVIKSLVDVFQRGADQDAVI

SEQ ID NO: 1649 - protein, 126 aa, Solanum lycopersicum
ACGNFELTDEPTWIVDPLDGTTNFVHGFPFVCVSIGLTIEKKPTVGVVYNPIIDELFTGIDGKGAFLNGKPIKVSSQSELVKALLATEAGTNRDKLVVDATTGRINSLLFKVRSLRMCGSCALNLC

SEQ ID NO: 1650 - protein, 126 aa, Oryza sativa
TDIVVGAACADLRHQLDVSYPVTNGIVQSWDDMGHIWDHAFYSELKVDPSECKILLTDPPLNPVKNREKMIETMFEKYNFAGVFIQVQAVLSLYAQGLLTGLVIDSGDGVTHVVPVVDGFSYPHIT

SEQ ID NO: 1651 - protein, 76 aa, Oryza sativa
GTICTDKTGTLTTNHMVVDKIWISEVSKSVTSNTISGELNSVVSSSTLSLLLQGIFENTSAEVVKEKDGKQTVLGT

SEQ ID NO: 1652 - protein, 276 aa, Zea mays
EKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLA

SEQ ID NO: 1653 - protein, 126 aa, Solanum lycopersicum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIG

SEQ ID NO: 1654 - protein, 151 aa, Solanum lycopersicum
SIDYRSVGSGPGSSYVPTKTTAVSAAAALMGVLVVYMGTKAATMVAAAASAALLVVLITFLWGRCSDGFFTKSRTLELEVEPQYAGARIEGDVVTLDFVKKMLDDFKNQKNLHKRYAYQIVLQTREMLRALPSLVDIVVPEGKHFTVCGDV

SEQ ID NO: 1655 - protein, 176 aa, Solanum lycopersicum
LDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGI

SEQ ID NO: 1656 - protein, 176 aa, Solanum lycopersicum
MANPQQPLLIKTHKQNPIISFKILSFVITLFVALFLVAPYQVEIKHSNLCKTAQDSQLCLSYVSDLISNEIVTTESDGHSILMKFLVNYVHQMNNAIPVVRKMKNQINDIRQHGALTDCLELLDQSVDFASDSIAAIDKRSRSEHANAQSWLSGVLTNHVTCLDELDSFTKAMING

SEQ ID NO: 1657 - protein, 101 aa, Oryza sativa
LIPNIQVMARSLPLDKHTLVTNLRGMFDEVVSVTGDGTNDAPALHEADIGLAMGIAGTEVAKESADVIVLDDNFTTIINVARWGRAVYINIQKFVQFQLTV

SEQ ID NO: 1658 - protein, 76 aa, Oryza sativa
TLRRPVRMYLNRNTDMIMVGGRHPMKARYSVGFKSDGKITALHLDLLINAGISADASPVIPGTIISGLKKYNWGAL

SEQ ID NO: 1659 - protein, 276 aa, Oryza sativa
AGIPELSAIVRKDKGIEIGAATSISRTIEILNQESESTSSPNGSVVFRKLAEHMSKVASPFVRNTASIGGNIILAHKYPFRSDIATILLGAAATVNLQVSSKTLHVTLEQFLEQPPLGHNTLLLSIFIPHWASDCKKEHTLVFETYRAAPRPLGNAVSYVNSAFLGHVSLDKSSGDNILSNLHLAFGAYGTEHAIRARKVEEYLTGKILSASVVLEAIRLLRETIVPVEGTTHPEYRVSVAVGFLFSFLSPLCKGVIEPGKTLSISEDLVHTDNVH

SEQ ID NO: 1660 - protein, 101 aa, Oryza sativa
WKLTLLALVIVPVISIAVRKFGRFLRELSHQTQAAAAVASSIAEESFGAIRTVRSFAQESHEVLRYGEKVDETLKLGLKQAKVVGMFSGGLNAASTLSVVI

SEQ ID NO: 1661 - protein, 251 aa, Zea mays
CVKAFATIDKLALVNVEGTGMAGVPGTANAIFGAVKDVGANVIMISQASSEHSVCFAVPEKEVALVSAALHARFREALAAGRLSKVEVIHNCSILATVGLRMASTPGVSATLFDALAKANINVRAIAQGCSEYNITIVLKQEDCVRALRAAHSRFFLSKTTLAVGIIGPGLIGRTLLNQLKDQAAVLKENMNIDLRVMGIAGSRTMLLSDIGVDLTQWKEKLQTEAEPANLDKFVHHLSENHFFPNRVLVD

SEQ ID NO: 1662 - protein, 76 aa, Oryza sativa
MFNEVVAVTGDGTNDAPALHEADIGLAMGIAGTEVAKENADVIIMDDNFSTIINVAKWGRSVYINIQKFVQFQLTV

SEQ ID NO: 1663 - protein, 226 aa, Oryza sativa
IRNCDNFQVNQNDVEKIIDWENTSPKLAEIPFKPARVLLQDFTGVPAVVDLAAMRDAMAKLGSDANKINPLVPVDLVIDHSVQVDVARSPNAVQSNMELEFKRNNERFGFLKWGSTAFHNMLVVPPGSGIVHQVNLEYLGRVVFNTDGIMYPDSVVGTDSHTTMIDGLGVAGWGVGGIEAEATMLGQPMSMVLPGVVGFKLTGKLQNGVTATDLVLTVTQMLRKHG

SEQ ID NO: 1664 - protein, 151 aa, Zea mays
ARATIQVYEETAGLMVNDPVLRTRKPLSVELGPGILGNIFDGIQRPLKTIAIKSGDVYIPRGVSVPALDKDVLWEFQPTKLGVGDVITGGDLYATVFENTLMQHHVALPPGSMGKISYIAPAGQYNLQDTVLELEFQGIKKKFTMLQTWPV

SEQ ID NO: 1665 - protein, 76 aa, Oryza sativa
EVVSVTGDGTNDAPALHEADIGLAMGIAGTEVAKESADVIVLDDNFTTIINVARWGRAVYINIQKFVQFQLTVNIV

SEQ ID NO: 1666 - protein, 276 aa, Oryza sativa
SGMYDGVGIMLTILLVVMITAASDYKQSLQFRDLDKEKKKIDVQVTRDGYRQKVSIYDIVVGDIVHLSIGDQVPADGLFIDGYSFVVDESNLSGESEPVHVSTANRFLLGGTKVQDGSARMLVTAVGMRTEWGNLMETLSQGGEDETPLQVKLNGVATIIGKIGLAFAVLTFTVLMARFLLGKAGAPGGLLRWRMVDALAVLNFFAVAVTIIVVAVPEGLPLAVTLSLAFAMKKLMQERALVRHLSACETMGSASCICTDKTGTLTTNHMVVEKIW

SEQ ID NO: 1667 - protein, 76 aa, Solanum lycopersicum
MEANKSMVKLVAFLIILVSSCFQSLTAQDLEIEVSDGLNVLQVHDVSQSFCPGVTKESWPELLGTPAKFAKQIIQK

SEQ ID NO: 1668 - protein, 76 aa, Oryza sativa
EVVAVTGDGTNDAPALHEADIGLAMGIAGTEVAKESADVIILDDNFSTIVTVAKWGRSVYVNIQKFVQFQLTVNVV

SEQ ID NO: 1669 - protein, 151 aa, Solanum lycopersicum
MATPLQPFLTKTHKQNPIIGFNILTFVVTLFVALFLVVFLVAPYQFEIKHSNLCKTAQDSQLCLSYVSEIVTTESDGVTVLKKFLVKYVHQMNNAIPVVRKIKNQINDIRQQGALTDCLELLDQSVDLVSDSIAAIDKRSRSEHANAQSWL

SEQ ID NO: 1670 - protein, 251 aa, Oryza sativa
SAIVRKDKGIEIGAATSISRTIEILNQESELTSSPNGSVVFRKLAEHMSKVASPFVRNTASIGGNIILAHKYPFRSDIATILLGAAATVNLQVSSKTLHVNLEQFLEQPPLDHSTLLLSIFIPHWASDCKKEHTLVFETYRAAPRPLGNAVSYVNSAFLGHVSLDKSSGDNILSNLHLAFGAYGTKHAIRARKVEEYLTGKILSASVVLEAIRLLRETIVPVEGTTHPEYRVSVAVGFLFSFLSPLCKGVI

SEQ ID NO: 1671 - protein, 226 aa, Solanum lycopersicum
LPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYETQFFPRVFGVSTLQRTATDDFRKLASAIYLQVSTISQALIF

SEQ ID NO: 1672 - protein, 126 aa, Oryza sativa
ILPMFPPVFHKWFLTTFSEPAAWIRARAAYAHTTAVWSMVGHIVGLGDRHGENILLDSTTGDCIHVDFSCLFDKGLLLEKPEVVPFRFTQNMVDGLGITGYEGVFVKVCEITLSVLRTHKEALMTV

SEQ ID NO: 1673 - protein, 101 aa, Solanum lycopersicum
AICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRIL

SEQ ID NO: 1674 - protein, 76 aa, Solanum lycopersicum
ALQPRSISLPIEGIAEAAARHFLTSITVYPIKSCAGFSVDQWPLTSTGLLHDREWILKSTTGEILTQKKVPEMCYI

SEQ ID NO: 1675 - protein, 201 aa, Zea mays
GGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGR

SEQ ID NO: 1676 - protein, 226 aa, Oryza sativa
GYTLIAVFGIKDPLRPGVREAVATCHAAGINVRMVTGDNINTAKAIARECGILTDDGIAIEGPEFRNKDPDQMREIIPKIQVMARSLPLDKHTLVTNLRGMFNEVVAVTGDGTNDAPALHEADIGLAMGIAGTEVAKENADVIIMDDNFSTIINVAKWGRSVYINIQKFVQFQLTVNVVALMVNFISASFTGSAPLTIVQLLWVNLIMDTLGALALATEPPNDAMM

SEQ ID NO: 1677 - protein, 251 aa, Zea mays
STPGVSAILFDALAKANINVRAIAQGCSEYNITVVLKQQDCVRALRAAHSRFFLSKTTLAVGIIGPGLIGGALLNQLKNQTAVLKENMNIDLRVIGITGSSTMLLSDTGIDLTQWKQLLQKEAEPADIGSFVHHLSDNHVFPNKVLVDCTADTSVASHYYDWLKKGIHVITPNKKANSGPLDQYLKLRTMQRASYTHYFYEATVGAGLPIISTLRGLLETGDKILRIEGIFSGTLSYIFNNFEGTRAFSDV

SEQ ID NO: 1678 - protein, 126 aa, Zea mays
LVVEISLQPWKVFKPDGVILFSDILTPLPGMNIPFDIVKGKGPVIYDPLRTAAAVNEVREFVPEEWVPYVGQALNILRQEVKNEAAVLGFVGAPFTLASYCVEGGSSKNFTLIKKMAFSEPAILHN

SEQ ID NO: 1679 - protein, 176 aa, Solanum lycopersicum
AALMARLAPKAKVLRDGKWDEEDASVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTM

SEQ ID NO: 1680 - protein, 101 aa, Solanum lycopersicum
AVVSVSIAYFGIFIASFLYKPIYSSLKNLEFINSFVKKGPKRILWDKILNGIYDWSYNRAYIDAFYTRFFVGGIRGLAEFTHFVDRRVIDGMTNGVGVISF

SEQ ID NO: 1681 - protein, 176 aa, Zea mays
IGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKD

SEQ ID NO: 1682 - protein, 76 aa, Oryza sativa
TGETRWRPFATMLIKLVNKCLADGTLYVEGLVNMPFVSAACSIICYGDESLHKVCFDFARIVATVITVEILPVENI

SEQ ID NO: 1683 - protein, 201 aa, Oryza sativa
TGTILYIVIIVVTGSVCTALRAWLFNSASERVVARLRKDLFSHLVNQEIAFFDVTRTGELLSRLSEDTQIIKNAATTNLSEALRNITTTSIGLGFMFATSWKLTLLALVIVPVISIAVRKFGRFLRELSHQTQAAAAVASSIAEESFGAIRTVRSFAQESHEVLRYGEKVDETLKLGLKQAKVVGMFSGGLNAASTLSVVI

SEQ ID NO: 1684 - protein, 126 aa, Zea mays
MAKDVEQVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVR

SEQ ID NO: 1685 - protein, 126 aa, Oryza sativa
PYVAAHNMILTHAAVVRLYREKYQTLQKGIVGINVLSLWSYPLTDSTADLQAAQRYKDFTYGWILHPLVFGDYPQVMKKAIGSRLPSFSKVQTELVKGTLDFIGVNHYFSLYVSDLPLAKGVRDFI

SEQ ID NO: 1686 - protein, 101 aa, Oryza sativa
KNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQ

SEQ ID NO: 1687 - protein, 76 aa, Oryza sativa
SVEPYIAVHNMLLAHASVTKLYREKYQVAGKGIIGISVYTFWAYPLTNSTVDLEATKRCQDFIVHWVLRPLVFGDY

SEQ ID NO: 1688 - protein, 76 aa, Solanum lycopersicum
LVSIHFPPDYPFKPPKVAFRTKVFHPNINSNGSICLDILKEQWSPALTISKVLLSICSLLTDPNPDDPLVPEIAHM

SEQ ID NO: 1689 - protein, 126 aa, Zea mays
VFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVL

SEQ ID NO: 1690 - protein, 101 aa, Zea mays
TIIATGFIASTPENIPTTLKRDGSDFSAAIIGSLVKARQVTIWTDVDGVFSADPRKVSEAVILSTLSYQEAWEMSYFGANVLHPRTIIPVMKYNIPIVIRN

SEQ ID NO: 1691 - protein, 276 aa, Zea mays
SFATVDNLALVNVEGTGMAGVPGTASAIFSAVKDVGANVIMISQASSEHSVCFAVPEKEVAVVSAELHDRFREALAAGRLSKVEVINGCSILAAVGLRMASTPGVSAILFDALAKANINVRAIAQGCSEYNITVVLKQQDCVRALRAAHSRFFLSKTTLAVGIIGPGLIGGALLNQLKNQTAVLKENMNIDLRVIGITGSSTMLLSDTGIDLTQWKQLLQKEAEPADIGSFVHHLSDNHVFPNKVLVDCTADTSVASHYYDWLKKGIHVITPNKKA

SEQ ID NO: 1692 - protein, 226 aa, Solanum lycopersicum
FTGKEFMAFSSQQQIEILSQDGGKVFSRAEPRHKQEIVRMLKEMGEIVAMTGDGVNDAPALKLADIGIAMGITGTEVAKEASDMVLADDNFSTIVSAVAEGRSIYNNMKAFIRYMISSNVGEVISIFLTAVLGIPECLIPVQLLWVNLVTDGPPATALGFNPADVDIMQKPPRKNTDALINSWVFFRYMVIGSYVGIATVGIFIVWYTQASFLGINIVSDGHTLVE

SEQ ID NO: 1693 - protein, 151 aa, Solanum lycopersicum
RFVTGGLAGQLYLNVKKWLGYRDQVLHSGEGPIHAVKWRTSLVAWANDTGVKVYDASNDQRITFIERPRGIPRPELLLPHIVWQDDSLLVIGWGTSVKIALIRTTQSKGANGTYKHMSMSSLNQVDIVASFQTSYFISGIAPFGDSLVILA

SEQ ID NO: 1694 - protein, 201 aa, Solanum lycopersicum
IVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYKTNFFPRIFGVSTLEKTATDDFRKLASAIYLQVSTISQAL

SEQ ID NO: 1695 - protein, 251 aa, Oryza sativa
VSTANRFLLGGTKVQDGSARMLVTAVGMRTEWGNLMETLSQGGEDETPLQVKLNGVATIIGKIGLAFAVLTFTVLMARFLLGKAGAPGGLLRWRMVDALAVLNFFAVAVTIIVVAVPEGLPLAVTLSLAFAMKKLMQERALVRHLSACETMGSASCICTDKTGTLTTNHMVVEKIWASGAAQTMSNAKGFDQLTSSMSETFAKVLLEGVFHCSGSEVVRGKDGRHTIMGTPTETAILEFGLAVEKRARIEH

SEQ ID NO: 1696 - protein, 176 aa, Zea mays
ECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLA

SEQ ID NO: 1697 - protein, 226 aa, Solanum lycopersicum
FLSKTKYPIAKNGRKMTRPFMTIAHFKHKAVSSYPYESDNTMLFPIFVLGLFTLFVGAIGIPFNQEGVNLDILSKWLAPSINLLHPKSNNSLDWNEFLKDAVVSVSIAYFGIFIASFLYKPIYSSLKNLEFINSFVKKGPKRILWDKILNGIYDWSYNRAYIDAFYTRFFVGGIRGLAEFTHFVDRRVIDGMTNGVGVISFIVGEGIKYIGGGRISSYLFLYLAYV

SEQ ID NO: 1698 - protein, 276 aa, Oryza sativa
VVSLGIMSAGAVFSGVNPRALAAEIKKQVEDSEAKLVVANEVAFDKVKDAGVPVIGVGDRERMPGAISWDGLLAAADRTGAGVVPVDAAQQSDLCALPYSSGTTGVSKGVMLSHRNLVSNLCSSMFAVAPETAGQVVTLGLMPFFHIYGITGICCATLRHKGTVVVMDRFDLRTFLRALVDHRVMFAPLVPPVMLAMVKSPVADEFDLSDLALKSVMTAAAPLAPDLLAAFQRKFPGVQVEEAYGLTEHSCITLTHAAGDGHGHVAKKSSVGFILP

SEQ ID NO: 1699 - protein, 126 aa, Oryza sativa
SAIVRKDKGIEIGAATSISRTIEILNQESELTSSPNGSVVFRKLAEHMSKVASPFVRNTASIGGNIILAHKYPFRSDIATILLGAAATVNLQVSSKTLHVNLEQFLEQPPLDHSTLLLSIFIPHWA

SEQ ID NO: 1700 - protein, 201 aa, Oryza sativa
KNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQLLADVSFLIFVCSWAVLRLIYYPFWILWSTSYEVVPMLDKKKHKFDGPLHYYVFNCLLFSLLVLNIYWWVLMYRMLVEQILSKGHVGDDVRSGRFSPPFI

SEQ ID NO: 1701 - protein, 101 aa, Oryza sativa
KPVLEVSSHGHAIVAFVNDAFVGCGHGTKINKAFTMEKAMDLKVGVNHVAILSSTLGLMDSGSYLEHRMAGVYTVTIRGLNTGTLDLTTNGWGHVVGLDGE

SEQ ID NO: 1702 - protein, 76 aa, Oryza sativa
MVLVAIGVVVAAAVVVSSLLLRWNEVRYSRKRGLPPGTMGWPLFGETTEFLKQGPSFMKARRLRYGSVFRTHILGC

SEQ ID NO: 1703 - protein, 101 aa, Oryza sativa
TGTILYIVIIVVTGSVCTALRAWLFNSASERVVARLRKDLFSHLVNQEIAFFDVTRTGELLSRLSEDTQIIKNAATTNLSEALRNITTTSIGLGFMFATSW

SEQ ID NO: 1704 - protein, 126 aa, Zea mays
MPIGVPKVPYRIPGDEEATWVDLYNVMYRERTLFLGQEIRCEITNHITGLMVYLSIEDGNSDIFLFINSLGGWLISGMAIFDTMQTVTPDIYTICLGIAASMASFILLGGEPTKRIAFPHARIMLH

SEQ ID NO: 1705 - protein, 101 aa, Oryza sativa
GNFTAGTCHTPDAKAIVEKECLGKESCVLPVVNTVYGADINCPATTATLAVQLLLASHVMRIAICVRPMLFARNGIVTSVLAHILGHPEWDRKSLRVKMAG

SEQ ID NO: 1706 - protein, 201 aa, Oryza sativa
LIPNIQVMARSLPLDKHTLVTNLRGMFDEVVSVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDEMMKRPPVRKGESFITKVMWRNIMGQSLYQLFVLGALMFGGESLLNIKGADSK

SEQ ID NO: 1707 - protein, 151 aa, Zea mays
YTLTPVSRLLIGSQSSQLAQTPLAAMVLDPTIVSPFSELGAWFQHELPDPCIFKHTHGRGIWELTKDDATFDALVNDGLASDSQLIVDVAIKQSAEVFQGISSLVDVGGGIGAAAQAISKAFPHVKCSVLDLAHVVAKAPTHTDVQFIAGD

SEQ ID NO: 1708 - protein, 126 aa, Zea mays
MAQAVEEWYRQMPIITRSYLTAAVVTTVGCTLEIISPYHLYLNPKLVVQHYEIWRLVTNFLYFRKMDLDFLFHMFFLARYCKLLEENSFRGRTADFFYMLLFGATVLTGIVLIGGMIPYISETFAR

SEQ ID NO: 1709 - protein, 176 aa, Oryza sativa
EVVSVTGDGTNDAPALHEADIGLAMGIAGTEVAKESADVIVLDDNFTTIINVARWGRAVYINIQKFVQFQLTVNIVALVINFVSACIIGSAPLTAVQLLWVNMIMDTLGALALATEPPNDEMMKRPPVRKGESFITKFMWRNIMGQSLYQLFVLGALMFGGERLLNIKGADSKSII

SEQ ID NO: 1710 - protein, 76 aa, Zea mays
THLRMIVTSADVLHSWAVPSLGVKCDAVPGRLNLTSILVQREGVYYGQCSEICGTNHAFMPIVVEAVTLKDYADWV

SEQ ID NO: 1711 - protein, 151 aa, Zea mays
DVLAIQVSTVASESAFSAGGRVVDPYRNRLGSEIVEALICTKDWVAASRKGEWHICYNEVPIYSYSTIILLILMHICVIQGATYFPTMIGDLEVLDSVIAAATNHENHMDEVFKDYYLLRAWAINLLLFTTVLMHGLFLSPCFDACALLPS

SEQ ID NO: 1712 - protein, 101 aa, Solanum lycopersicum
LPVINQVFGTNHVVKISPNSPVARLRPAGKYMPGEVVAVRVPLLHLSNFQINDWPELSTKRYALMVLMLPSDSARQWHVHELELVEVVADQVAVALSHAAI

SEQ ID NO: 1713 - protein, 151 aa, Solanum lycopersicum
YASRTLLFLQDNGSLKPLAIELSLPHPDGDQFGVTSKVYTPSDQGVEGSIWQLAKAYVAVNDSGVHQLISHWLNTHAVIEPFVIATNRQLSVLHPIHKLLYPHFRDTMNINALARQILINAGGVLESTVFPSKFAMEMSAVVYKDWVFPDQ

SEQ ID NO: 1714 - protein, 226 aa, Solanum lycopersicum
PPFMVLIIAILNDGTIMTISKDRVKPSPLPDSWKLAEIFTTGVVLGGYLAMMTVIFFWAAYKTNFFPRIFGVSTLEKTATDDFRKLASAIYLQVSTISQALIFVTRSRSWSFVERPGLLLVFAFFVAQLVATLIAVYANWSFAAIEGIGWGWAGVIWLYNIVTYIPLDLIKFLIRYALSGKAWDLVLEQRIAFTRKKDFGKELRELQWAHAQRTLHGLQVPDPKIF

SEQ ID NO: 1715 - protein, 101 aa, Solanum lycopersicum
VLIPALRTVGNIVTGDDIQTQVMIDHHALPCLVNLLTQNYKKSIKKEACWTISNITAGNRNQIQIVIEAGIIAPLVYLLQNAEFEIKKEAAWAISNATSGG

SEQ ID NO: 1716 - protein, 201 aa, Oryza sativa
SLKSMYQEVVAVTGDGTNDAPALHESDIGLAMGITGTEVAKESADVIIMDDNFETIVNVARWGRAVYLNIQKFVQFQLTVNIVALIVNFVSACIIGSAPLTAVQLLWVNMIMDTLGALALATEPPNDEMMKRPPVRRGDNFITRIMWRNILGQGLYQLLVLATLMVIGKKLLSIEGPQSDKTINTLIFNSFVFCQVFNEIN

SEQ ID NO: 1717 - protein, 101 aa, Oryza sativa
VGLLEQINVTRDNTDYLWYTTYVDVAQDEQFLSNGENLKLTVMSAGHALHIFINGQLKGTVYGSVDDPKLTYTGNVKLWAGSNTISCLSIAVGLPNVGEHF

SEQ ID NO: 1718 - protein, 101 aa, Oryza sativa
SLKSMYQEVVAVTGDGTNDAPALHESDIGLAMGITGTEVAKESADVIIMDDNFETIVNVARWGRAVYLNIQKFVQFQLTVNIVALIVNFVSACIIGSAPLT

SEQ ID NO: 1719 - protein, 76 aa, Oryza sativa
NDGVVAISEVTGFPKLDLMLLGMGPDGHVASLFPGHPVVNENLKWVSYIKDSPKPPPERITFTFPLVNSSAHIALV

SEQ ID NO: 1720 - protein, 76 aa, Solanum lycopersicum
HPDGDQFGTVSKVYTPADQGVEGSIWQFAKAYVAVNDMGIHQLISHWLNTHAVIEPFVVATNRHLSVLHPIHKLLH

SEQ ID NO: 1721 - protein, 226 aa, Oryza sativa
VFVNEDNPYLLSGTKVLDGSCKMLVTAVGMRTQWGKLMAVLTDGGDDETPLQTRLNGVANTIGKIGLFFAVLTFIVLSQGIIGQKYLDGLLLSWSGDDVLEILDHFAVAVTIVVVAVPEGLPLAVTLSLAFAMKKMMNDKALVRQLAACETMGSATVICSDKTGTLTTNRMTVVKACICGNTIQVNNPQTPNMSSNFPEVAVETLLESIFNNTSGEVVTNQDGKYQ

SEQ ID NO: 1722 - protein, 176 aa, Oryza sativa
EVVAVTGDGTNDAPALHEADIGLAMGIAGTEVAKESADVIILDDNFSTIVTVAKWGRSVYVNIQKFVQFQLTVNVVALLVNFSSACFTGNAPLTAVQLLWVNMIMDTLGALALATEPPNDDLMKREPVGRTGKFITNVMWRNILGQSFYQFIVMWYLQTQGKSMFGLDGPDAEVVL

SEQ ID NO: 1723 - protein, 76 aa, Solanum lycopersicum
MSVWNYVVTAHKPTNVTHSCVGNFTGPQELNLIIAKCTRIEIHLLTPQGLQPMLDVPIYGRIATLELFRPHGETQD

SEQ ID NO: 1724 - protein, 251 aa, Solanum lycopersicum
AVSITIRIVLGFMLLALIWKFDFPPFMVLIIAILNDGTIMTISKDRVKPSPLPDSWKLAEIFTTGVVLGGYLAMMTVIFFWAAYETQFFPRVFGVSTLQRTATDDFRKLASAIYLQVSTISQALIFVTRSRSWSFVERPGLLLVVALIVAQLVATLIAVYASWSFAAIEGIGWGWAGVIWLYNLVFYFPLDIIKFLIRYALSGRAWDLVLEQRIAFTRKKDFGKEQRELQWAHAQRTLHGLQVPDIKLFSE

SEQ ID NO: 1725 - protein, 201 aa, Solanum lycopersicum
ESAWKCIYFLSAEVFALVVTYNEPWFTNTRYFWVGPGDQVWPDQMYKSKLKALYMYTGGFYTYSIFALIFWETRRSDFGVSMSHHVATAILIVLSYNIRFARVGSVVLAIHDASDIFLEIGKMSKYSGAEALASFRYLCLSWIILRLIYYPFWVLWSTSYEVLQTLDKEKHKVDGPIYYYIFNSLLFCLLVLHIYWWVLIY

SEQ ID NO: 1726 - protein, 126 aa, Solanum lycopersicum
WFTDSRYFWAGPGDVVWPNLKMKLKLKLLYMYAGGFYFYSIFATLYWETRRYDFAAQIIHHVTTVSLIVLSYVYGFARIGSVVLALHDGSDVFMEIAKMSKYSGFDLIADIFFSLFALVFTSLRII

SEQ ID NO: 1727 - protein, 76 aa, Solanum lycopersicum
MGIIKGVLFSIVLINLSLVVFCGYPRRPVDVPFWKNYEPSWASHHIKFLNGGTTTDLILDRSSGAGFQSKKSYLFG

SEQ ID NO: 1728 - protein, 76 aa, Solanum lycopersicum
RVQIKDTGIGITPQDIPNLFSKFTQSQALATTNSGGTGLGLAICKRFVNLMEGHIWIESEGLGKGSTAIFIIKLGI

SEQ ID NO: 1729 - protein, 151 aa, Oryza sativa
DDLSSMFPRIKHLAVEQTNAMPAVLSRYGVRSFPSILIACGPYAYWPVGSKELDSLVNVYTAVTGQEPIAYLGPRKWSAARTGSTQHVKLWKSSIIEALKSEPYLAFSILFICLKILVAFFPKFFSCIKGIWVQYFRHANLGILAKLTQLL

SEQ ID NO: 1730 - protein, 126 aa, Zea mays
LLTFDGYLRVHFQNYSSTKEGSLYSISLWGKSISKGVNRDFVLSTMKSGVSFFSQNIPKIPANTRNKIGSFSTPFGAKNTFVYPHETGNTMLFPLLILLLFTLFIGSIGIHFDNGVKDNRILELTI

SEQ ID NO: 1731 - protein, 201 aa, Oryza sativa
AVMGLLIPAALHYTHSEAQFGKSELALSRFSSCIMLVAYASYLYFQLSNNRRRNEANVYPCMPLIKRRIQDDVDGNDDEVPEISKREAISWIAIFIAWISMLSYYLVDAIDGASKAWNIPVAFISVVLLPVVGNSAGHANAVMFAVKDKLDISLGVAIGSSIQISMFGIPFCVVMGWMMGKPMDLNFHLFETASLLTTVLV

SEQ ID NO: 1732 - protein, 76 aa, Zea mays
AAEIIGTFVLVYTVFSATDPKRSARDSHVPVLAPLPIGFAVFMVHLATIPITGTGINPARSLGAAVIYNKDKAWDD

SEQ ID NO: 1733 - protein, 76 aa, Solanum lycopersicum
IGFNMLAEKFKYDDPLEAAQLHGGCGAWGIIFTGLFAKGEFVDQVYPGKPGRPHGLFMGGGGKLLGAHIIQILVII

SEQ ID NO: 1734 - protein, 126 aa, Oryza sativa
AVAKLLNVSTNDILIQSTGVIGQRIKKEALVNSLHRLVGSLSSSIEGANSAAVAITTTDLVSKSIAVQTEIGGVPIKIGGMAKGSGMIHPNMATMLGVLTTDAQVSSDVWREMVRTSVSRSFNQIT

SEQ ID NO: 1735 - protein, 126 aa, Zea mays
MNWRSEHIWIELLKGSRKRGNFFWACILFLGSLGFLAVGASSYLGKNMISVLPSQQILFFPQGVVMSFYGIAGLFISSYLWCTILWNVGSGYDRFDRKEGIVCIFRWGFPGIKRRIFLQFLVRDIQ

SEQ ID NO: 1736 - protein, 151 aa, Solanum lycopersicum
MAIFLIIFVVFFGFCILSTPLFRWIDIVYNKKNLPPGTMGWPIFGETREFLNQGPNFMKNQRARYGNFFKSHILGCPTVVSMDAGLNVYILNNEAKGLIPGYPQSMLDILGKCNIAAVHGATHKYIRGALLSLINPTMIKDHILPKIDKFM

SEQ ID NO: 1737 - protein, 76 aa, Solanum lycopersicum
MNYFPWLTIIVVFPIFAGSLIFFLPHKGNRVIRWYTICICILELLLTTYAFCYHFQSDDPLIQLVEDYKWIDFFDF

SEQ ID NO: 1738 - protein, 151 aa, Zea mays
MAQAVEEWYRQMPIITRSYLTAAVVTTVGCTLEIISPYHLYLNPKLVVQHYEIWRLVTNFLYFRKMDLDFLFHMFFLARYCKLLEENSFRGRTADFFYMLLFGATVLTSIVLIGGMIPYISETFARILFLSNSLTFMMVYVWSKHNPFIHM

SEQ ID NO: 1739 - protein, 176 aa, Oryza sativa
TAFNEVVAVTGDGTNDAPALREADIGLAMGIAGTEVAKESADVVILDDNFSTIVTVAKWGRSVYVNIQKFVQFQLTVNVVALLVNFTSACFTGDAPLTAVQLLWVNMIMDTLGALALATEPPNNNLMKKAPVGRKGKFITNVMWRNIVGQSLYQFAVMWYLQTQGKHLFGLEGYHA

SEQ ID NO: 1740 - protein, 101 aa, Oryza sativa
WKLKAVYMYAAGFYTYSIFALMFWETRRSDFGVSMSHHVATVALIVLSYVFRFARVGSVVLAIHDASDVFLEVGKMAKYSHCDLLANVAFLLFVVSWVLLR

SEQ ID NO: 1741 - protein, 76 aa, Zea mays
RIPAQVIGAVLGVKLIQVTFPNVGKGARLSVGAHHGALAEGLATFMVVMVSVTLKKKEMKSFFMKTWITSIWKNTI

SEQ ID NO: 1742 - protein, 176 aa, Oryza sativa
MFNEVVAVTGDGTNDAPALHEADIGLAMGIAGTEVAKENADVIIMDDNFSTIINVAKWGRSVYINIQKFVQFQLTVNVVALMVNFISASFTGSAPLTIVQLLWVNLIMDTLGALALATEPPNDAMMKRPPVGRGDNFITKVMWRNIVGQSIYQLVVLGVLLLRGKSLLQINGPQAD

SEQ ID NO: 1743 - protein, 76 aa, Solanum lycopersicum
MGFWMAMLLMLLLCLWVSCGIASVSYDHKAIIVNGQRKILISGSIHYPRSTPEMWPDLIQKAKEGGVDVIQTYVFW

SEQ ID NO: 1744 - protein, 101 aa, Zea mays
IKKEALLNSLPRLVGSLSSSVQGANSAAVAITTTDLVSKSIAVQTEIGGVAIRIGGMAKGSGMIHPNMATMLGVLTTDAQVSSDVWREMIRMSVSRSFNQI

SEQ ID NO: 1745 - protein, 126 aa, Oryza sativa
FKRNNERFGFLKWGSTAFHNMLVVPPGSGIVHQVNLEYLGRVVFNTDGIMYPDSVVGTDSHTTMIDGLGVAGWGVGGIEAEATMLGQPMSMVLPGVVGFKLTGKLQNGVTATDLVLTVTQMLRKHG

SEQ ID NO: 1746 - protein, 126 aa, Zea mays
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRAL

SEQ ID NO: 1747 - protein, 76 aa, Oryza sativa
GAPMFHSMGFLFVLQGVALGATTVVVTDAVARAGIRGLVEAAERWAVMDMTASPPVVLGMTKQRCRLPALERITCG

SEQ ID NO: 1748 - protein, 101 aa, Solanum lycopersicum
GIFIVWYTQASFLGINIVSDGHTLVELSQLRNWGECSTWTNFTVSPFKAGNRLITFSDPCEYFTVGKVKAMTLSLSVLVAIEMFNSLNALSEDNSLIKMPP

SEQ ID NO: 1749 - protein, 151 aa, Oryza sativa
VNMIMDTLGALALATEPPNDEMMKRPPVRKGESFITKFMWRNIMGQSLYQLFVLGALMFGGERLLNIKGADSKSIINTLIFNSFVFCQVFNEINSREMQKINVFRGIISNWIFIAVIAATVAFQVVIIEFLGTFASTVPLNWQHWLLSVGL

SEQ ID NO: 1750 - protein, 76 aa, Oryza sativa
VLNFFAVAVTIIVVAVPEGLPLAVTLSLAFAMKKLMQERALVRHLSACETMGSASCICTDKTGTLTTNHMVVEKIW

SEQ ID NO: 1751 - protein, 176 aa, Zea mays
LTYVGAGMICSHLVNISTLLGAILSWGILWPLISKQKGEWYPANIPESSMKSLYGYKAFLCIALIMGDGTYHFFKVFGVTVKSLHQRLSRKRATNRVANGGDEMAALDDLQRDEIFSDGSFPAWAAYAGYAALTVVSAVIIPHMFRQVKWYYVIVAYVLAPLLGFANSYGTGLTDI

SEQ ID NO: 1752 - protein, 76 aa, Zea mays
LGAEIIGTFVLVYTVFSATDPKRNARDSHVPVLAPLPIGFAVFMVHLATIPVTGTGINPARSLGAAVIYNKDKPWD

SEQ ID NO: 1753 - protein, 276 aa, Oryza sativa
TAFNEVVAVTGDGTNDAPALREADIGLAMGIAGTEVAKESADVVILDDNFSTIVTVAKWGRSVYVNIQKFVQFQLTVNVVALLVNFTSACFTGDAPLTAVQLLWVNMIMDTLGALALATEPPNNNLMKKAPVGRKGKFITNVMWRNIVGQSLYQFAVMWYLQTQGKHLFGLEGYHADIVLNTIIFNTFVFCQVFNEISSREMEDINVLRGMAGNSIFLGVLTGTIFFQFILVQFLGDFANTTPLTQQQWLISILFGFLGMPIAAAIKLIAVEPHEK

SEQ ID NO: 1754 - protein, 126 aa, Oryza sativa
QLLWVNMIMDTLGALALATEPPNNNLMKKAPVGRKGKFITNVMWRNIVGQSLYQFAVMWYLQTQGKHLFGLEGYHADIVLNTIIFNTFVFCQVFNEISSREMEDINVLRGMAGNSIFLGVLTGTIF

SEQ ID NO: 1755 - protein, 76 aa, Zea mays
LAAEIIGTFVLVYTVFSATDPKRSARDSHVPVLAPLPIGFAVFMVHLATIPITGTGINPARSLGAAVIYNKDKAWD

SEQ ID NO: 1756 - protein, 276 aa, Solanum lycopersicum
PGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALAVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLD

SEQ ID NO: 1757 - protein, 201 aa, Oryza sativa
QADVSIGLLLLGVLCHIATLVSKYTSSTGDSINSSSVMQLSRSCAIVMLIAYFGSLMFQLKTHRQIFELEEDSSDSSSSEDDATDKSVIGFASAMVWLIGMAVVTAMLSSYVVTTIEEASESMGIPVRFISIILLPIVGNAAEHAGAIIFAFKNKIDISLGITLGSATQISMLVVPVILIVSWVNAIPMDLDFNLLETGSL

SEQ ID NO: 1758 - protein, 276 aa, Oryza sativa
EVVSVTGDGTNDAPALHEADIGLAMGIAGTEVAKESADVIVLDDNFTTIINVARWGRAVYINIQKFVQFQLTVNIVALVINFVSACIIGSAPLTAVQLLWVNMIMDTLGALALATEPPNDEMMKRPPVRKGESFITKFMWRNIMGQSLYQLFVLGALMFGGERLLNIKGADSKSIINTLIFNSFVFCQVFNEINSREMQKINVFRGIISNWIFIAVIAATVAFQVVIIEFLGTFASTVPLNWQHWLLSVGLGSISLIVGVILKCIPVGSGETSATP

SEQ ID NO: 1759 - protein, 176 aa, Zea mays
MSKVYDWFEERLEIQAIADDITSKYVPPHVNIFYCLGGITLTCFLVQVATGFAMTFYYRPTVTEAFSSVQYIMTEANFGWLIRSVHRWSASMMVLMMILHVFRVYLTGGFKKPRELTWVTGVVLAVLTASFGVTGYSLPWDQIGYWAVKIVTGVPEAIPVIGSPLVELLRGSASVG

SEQ ID NO: 1760 - protein, 101 aa, Oryza sativa
VMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIG

SEQ ID NO: 1761 - protein, 176 aa, Solanum lycopersicum
MSKVYDWFEERLEIQAIADDITSKYVPPHVNIFYCLGGITLTCFLVQVATGFAMTFYYRPTVTEAFASVQYIMTEANFGWLIRSVHRWSASMMVLMMILHVFRVYLTGGFKKPRELTWVTGVVLAVLTASFGVTGYSLPWDQIGYWAVKIVTGVPDAIPVIGSPLVELLRGSASVG

SEQ ID NO: 1762 - protein, 151 aa, Zea mays
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGF

SEQ ID NO: 1763 - protein, 76 aa, Zea mays
SWTDVDFCRRVKMTGWMYFVSKTLAEKAALAYAAEHGLDLVTIIPTLVVGPFISASMPPSLITALALITGNAPHYS

SEQ ID NO: 1764 - protein, 276 aa, Oryza sativa
MFNEVVAVTGDGTNDAPALHEADIGLAMGIAGTEVAKENADVIIMDDNFSTIINVAKWGRSVYINIQKFVQFQLTVNVVALMVNFISASFTGSAPLTIVQLLWVNLIMDTLGALALATEPPNDAMMKRPPVGRGDNFITKVMWRNIVGQSIYQLVVLGVLLLRGKSLLQINGPQADSLLNTFVFNTFVFCQVFNEVNSREMEKINVFSGIFSSWIFSAVVGVTAGFQVIMVELLGTFANTVHLSGKLWLTSVLIGSVGLVIGAILKCIPVESGSDA

SEQ ID NO: 1765 - protein, 176 aa, Oryza sativa
VIGAVQGMITGLVCITPGAGLVQGWAAIVMGILSGSIPWFTMMVVHKRSRLLQQVDDTLGVFHTHAVAGFLGGATTGLFAEPVLCSLFLPVTNSRGAFYPGRGGGLQFVRQVAGALFIICWNVVVTSLVCLAVRAVVPLRMPEEELAIGDDAVHGEEAYALWGDGEKYDSTKHGWY

SEQ ID NO: 1766 - protein, 226 aa, Zea mays
QGTDDKDYKEPPPAPLFEPGELKSWSFYRPGIAEFVATFLFLYISILTVMGVSKSTSKCATVGIQGIAWSFGGMILALVYCTAGISGHINPAVTFGLFLARKLSLTRAVFYIIMQCLGAICGRGVVKGFQQGLYMGNGGRRNVVAPGYTKGDGLGAEIVGTFILVYTVFSATDAKRRARDSHVPILAPLPIGFAVFLVHLATMGITGTGINPARSLGAAVIYNQHH

SEQ ID NO: 1767 - protein, 176 aa, Zea mays
MNITPCSIKTLKGLYDISGVEVGQHFYWQIGGFQIHAQVLITSWVVITILLGSVIIAVRNPQTIPTDGQNFFEYVLEFIRDLSKTQIGEEYGPWVPFIGTMFLFIFVSNWSGALLPWKIIELPHGELAAPTNDINTTVALALLTSAAYFYAGLSKKGLSYFEKYIKPTPILLPINI

SEQ ID NO: 1768 - protein, 126 aa, Zea mays
QGTDDKDYKEPPPAPLFEPGELKSWSFYRPGIAEFVATFLFLYISILTVMGVSKSTSKCATVGIQGIAWSFGGMILALVYCTAGISGHINPAVTFGLFLARKLSLTRAVFYIIMQCLGAICGRGVV

SEQ ID NO: 1769 - protein, 251 aa, Oryza sativa
YTGPTVGGLLNATFGNATEMIIAIYALKNGMIRVVQQSLLGSILSNMLLVMGCAFFAGGIVHRNKDQVFSKATAVVNSGLLLMAVMGLMFPAVLHFTHSEVRQGASEVSLSRFSSCIMLVAYASYLYFQLSGRNNAYSPIGSEEMPNEDAAEEDEESEIGMWESIAWLAMLTLWVSILSEYLVNAIEGASDSLNLPVAFISVILLPIVGNAAEHASAIMFAMKDKLDITLGVAIGSSTQISMFVIPFCVVI

SEQ ID NO: 1770 - protein, 176 aa, Solanum lycopersicum
ITGPSAILTQGFATSGILTEIHQSGILVPALQSEWLIMHVSMMILGYAALLCGSLLSVALLVITFRKNRKLFSKSNVFLNESFFLGENVVENTSFFCTKNYYRSQLIQQLDYWSYRVISLGFTFLTIGILSGAVWANEAWGSYWNWDPKETWAFITWIVFAIYLHTRTNRNLRGPN

SEQ ID NO: 1771 - protein, 101 aa, Zea mays
VMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIG

SEQ ID NO: 1772 - protein, 226 aa, Solanum lycopersicum
GRSIYNNMKAFIRYMISSNVGEVISIFLTAVLGIPECLIPVQLLWVNLVTDGPPATALGFNPADVDIMQKPPRKNTDALINSWVFFRYMVIGSYVGIATVGIFIVWYTQASFLGINIVSDGHTLVELSQLRNWGECSTWTNFTVSPFKAGNRLITFSDPCEYFTVGKVKAMTLSLSVLVAIEMFNSLNALSEDNSLIKMPPWRNPWLLVAMSLSFALHSVILYVPF

SEQ ID NO: 1773 - protein, 151 aa, Zea mays
MGLPWYRVHTVVLNDPGRLLSVHIMHTALVSGWAGSMALYELAVFDPSDPVLDPMWRQGMFVIPFMTRLGITNSWGGWSISGGTVTNPGIWSYEGVAGAHIVFSGLCFLAAIWHWVYWDLEIFCDERTGKPSLDLPKIFGIHLFLAGVACF

SEQ ID NO: 1774 - protein, 151 aa, Solanum lycopersicum
MGLPWYRVHTVVLNDPGRLLSVHIMHTALVAGWAGSMALYELAVFDPSDPVLDPMWRQGMFVIPFMTRLGITNSWGGWSITGGTVTNPGIWSYEGVAGAHIVFSGLCFLAAIWHWVYWDLEIFCDERTGKPSLDLPKIFGIHLFLSGVACF

SEQ ID NO: 1775 - protein, 126 aa, Oryza sativa
GPWLFVGIPDAVKVWNMQTQAEMNLTGPTGQVYALAVGNELLFAATQDGRILAWRFSAATNGFEPAASLVGHQLAVVSLVVGAMRLYSASMDKTIRVWDLATLQCIQTLSDHTGVVMSVLCWDQFL

SEQ ID NO: 1776 - protein, 226 aa, Zea mays
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTG

SEQ ID NO: 1777 - protein, 176 aa, Zea mays
PYLATDYGTQLSLFTHHMWIGGFLIVGAAAHAAIFMVRDYDPTTRYNDLLDRVLRHRDAIISHLNWVCIFLGFHSFGLYIHNDTMSALGRPQDMFSDAAIQLQPIFAQWIQNIHAGAPGVTAPGATTSTSLTWGGGELVAIGGKVALLPIPLGTADFLVHHIHAFTIHVTVLILLK

SEQ ID NO: 1778 - protein, 176 aa, Oryza sativa
MNIIPCSIKTLKGLYDISGVEVGQHFYWQIGGFQIHAQVLITSWVVITILLGSVIIAVRNPQTIPTDGQNFFEYVLEFIRDLSKTQIGEEYGPWVPFIGTMFLFIFVSNWSGALLPWKIIQLPHGELAAPTNDINTTVALALLTSAAYFYAGLSKKGLSYFEKYIKPTPILLPINI

SEQ ID NO: 1779 - protein, 76 aa, Solanum lycopersicum
MDCNCFDPLLPADELLMKYQYISDFFIAVAYFSIPIELVYFVQKSAVFPYRWVLVQFGAFIVLCGATHLINLWTST

SEQ ID NO: 1780 - protein, 101 aa, Zea mays
EIIGTFVLVYTVFSATDPKRNARDSHVPVLAPLPIGFAVFMVHLATIPVTGTGINPARSFGPAVIFNNDKAWDDQWIYWVGPFVGAAVAAIYHQYILRGSA

SEQ ID NO: 1781 - protein, 101 aa, Zea mays
AGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYI

SEQ ID NO: 1782 - protein, 126 aa, Solanum lycopersicum
GRSIYNNMKAFIRYMISSNVGEVISIFLTAVLGIPECLIPVQLLWVNLVTDGPPATALGFNPADVDIMQKPPRKNTDALINSWVFFRYMVIGSYVGIATVGIFIVWYTQASFLGINIVSDGHTLVE

SEQ ID NO: 1783 - protein, 176 aa, Oryza sativa
VNIVALVINFVSACITGSAPLTAVQLLWVNMIMDTLGALALATEPPNDEMMKRPPVRKGESFITKVMWRNIMGQSLYQLFVLGALMFGGESLLNIKGADSKSIINTLIFNSFVFCQVFNEINSREMQKINVFRGIISNWIFIAVIAATVAFQVVIIEFLGTFASTVPLNWQHWLLS

SEQ ID NO: 1784 - protein, 201 aa, Zea mays
GDEMAALDDLQRDEIFSDGSFPAWAAYAGYAALTVVSAVIIPHMFRQVKWYYVIVAYVLAPLLGFANSYGTGLTDINMAYNYGKIALFIFAAWAGRDNGVIAGLAGGTLVKQLVMASADLMHDFKTGHLTMTSPRSLLVAQFIGTAMGCVVAPLTFLLFYNAFDIGNPTGYWKAPYGLIYRNMAILGVEGFSVLPRHCLAL

SEQ ID NO: 1785 - protein, 151 aa, Zea mays
RKLSLTRAVFYIIMQCLGAICGRGVVKGFQQGLYMGNGGRRNVVAPGYTKGDGLGAEIVGTFILVYTVFSATDAKRRARDSHVPILAPLPIGFAVFLVHLATMGITGTGINPARSLGAAVIYNQHHAWADHWIFWVGPFIGAALAAIYHQV

SEQ ID NO: 1786 - protein, 201 aa, Zea mays
QGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAVCGAGVVKGFQQGLYMGNGGGANVVAPGYTKGDGLGAEIVGTFILVYTVFSATDAKRNARDSHVPILAPLPIGFAVFLVH

SEQ ID NO: 1787 - protein, 151 aa, Zea mays
LLHLAALHQYGSNNPLGVHSEMDKIASYPYFYVKDLVGRVASAIFFSIWIFFAPNVLGHPDNYIPANPMPTPPHIVPEWYFLPIHAILRSIPDKAGGVAAIAPVFISLLALPFFKEMYVRSSSFRPIHQGIFWLLLADCLLLGWIGCQPVE

SEQ ID NO: 1788 - protein, 201 aa, Solanum lycopersicum
AQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLA

SEQ ID NO: 1789 - protein, 76 aa, Zea mays
AAEIIGTFVLVYTVFSATDPKRNARDSHVPVLAPLPIGFAVFMVHLATIPITGTGINPARSLGAAVVYNNSKAWSD

SEQ ID NO: 1790 - protein, 126 aa, Oryza sativa
MSSSATVVPLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATVHYRADGSVE

SEQ ID NO: 1791 - protein, 151 aa, Zea mays
VSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIF

SEQ ID NO: 1792 - protein, 201 aa, Zea mays
MAGGGDHSQTNGGHVDQRALEEGRKEEFADQGCAAMVVSVPFIQKIIAEIFGTYFLMFAGCGAVTINASKNGQITFPGVAIVWGLAVMVMVYAVGHISGAHFNPAVTLAFATSGRFPWRQLPAYVLAQMLGATLASGTLRLMFGGRHEHFPGTLPTGSEVQSLVIEIITTFYLMFVISGVATDNRAIGELAGLAVGATILL

SEQ ID NO: 1793 - protein, 76 aa, Zea mays
APLIDIDELGKWSLYRAVIAEFVATLLFLYITVATVIGYKHQTDASASGPDAACSGVGILGIAWAFGGMIFILVYC

SEQ ID NO: 1794 - protein, 101 aa, Solanum lycopersicum
CGFIAAWVLIGFNALAAKLKYDDPLEAAQLHGGCGSWGIIFTGLFAKKEYVNEVYPGFPNRPYGLFMGGGGKLLGAQVIQVVVIIGWVSVTMGPLFYLLHK

SEQ ID NO: 1795 - protein, 151 aa, Solanum lycopersicum
IVFSGLCFLAAIWHWVYWDLEIFCDERTGKPSLDLPKIFGIHLFLSGVACFGFGAFHVTGLYGPGIWVSDPYGLTGKVQPVNPAWGVEGFDPFVPGGIASHHIAAGTLGILAGLFHLSVRPPQRLYKGLRMGNIETVLSSSIAAVFFAAFV

SEQ ID NO: 1796 - protein, 126 aa, Zea mays
MSTGVRPGRRFTVGRSEDATHPDTIRAAISEFIATAIFVFAAEGSVLSLGKMYHDMSTAGGLVAVALAHALALAVAVAVAVNISGGHVNPAVTFGALVGGRVSLVRAVLYWVAQLLGAVAATLLLR

SEQ ID NO: 1797 - protein, 226 aa, Zea mays
QGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAII

SEQ ID NO: 1798 - protein, 151 aa, Zea mays
IVFSGLCFLAAIWHWVYWDLEIFCDERTGKPSLDLPKIFGIHLFLAGVACFGFGAFHVTGLYGPGIWVSDPYGLTGKVQAVNPAWGAEGFDPFVPGGIASHHIAAGTLGILAGLFHLSVRPPQRLYKGLRMGNIETVLSSSIAAVFFAAFV

SEQ ID NO: 1799 - protein, 251 aa, Zea mays
MGLPWYRVHTVVLNDPGRLLSVHIMHTALVSGWAGSMALYELAVFDPSDPVLDPMWRQGMFVIPFMTRLGITNSWGGWSISGGTVTNPGIWSYEGVAGAHIVFSGLCFLAAIWHWVYWDLEIFCDERTGKPSLDLPKIFGIHLFLAGVACFGFGAFHVTGLYGPGIWVSDPYGLTGKVQAVNPAWGAEGFDPFVPGGIASHHIAAGTLGILAGLFHLSVRPPQRLYKGLRMGNIETVLSSSIAAVFFAAFV

SEQ ID NO: 1800 - protein, 251 aa, Solanum lycopersicum
MGLPWYRVHTVVLNDPGRLLSVHIMHTALVAGWAGSMALYELAVFDPSDPVLDPMWRQGMFVIPFMTRLGITNSWGGWSITGGTVTNPGIWSYEGVAGAHIVFSGLCFLAAIWHWVYWDLEIFCDERTGKPSLDLPKIFGIHLFLSGVACFGFGAFHVTGLYGPGIWVSDPYGLTGKVQPVNPAWGVEGFDPFVPGGIASHHIAAGTLGILAGLFHLSVRPPQRLYKGLRMGNIETVLSSSIAAVFFAAFV

SEQ ID NO: 1801 - protein, 126 aa, Zea mays
TIKALEPFFSAAATQFILGQQVPFSLWLSLAPVVIGVSMASLTELSFNWTGFINAMISNISFTYRSIYSKKAMTDMDSTNVYAYISIIALIVCIPPALIFEGPKLMQHGFSDAIAKVGLTKFVSDL

SEQ ID NO: 1802 - protein, 76 aa, Zea mays
MTIRNQRFSLLKQPIYSTLNQHLIDYPTPSNLSYWWGFGCLAGICLVIQIVTGVFLAMHYTPHVDLAFNSVEHIMR

SEQ ID NO: 1803 - protein, 201 aa, Zea mays
IAGLAGGTLVKQLVMASADLMHDFKTGHLTMTSPRSLLVAQFIGTAMGCVVAPLTFLLFYNAFDIGNPTGYWKAPYGLIYRNMAILGVEGFSVLPRHCLALSAGFFAFAFVFSVARDVLPRKYARFVPLPMAMAVPFLVGGSFAIDMCVGSLAVFVWEKVNRKEAVFMVPAVASGLICGDGIWTFPSSILALAKIKPPICM

SEQ ID NO: 1804 - protein, 126 aa, Zea mays
MSTATGVRAGRRFTVGRSEDATHPDTIRAAISEFIATAIFVFAAEGSVLSLGKMYHDHSTISTAGGLVAVALAHALGLAVAVAVAVNVSGGHVNPAVTFGALVGGRVSLVRAVLYWAAQLLGAVAA

SEQ ID NO: 1805 - protein, 201 aa, Zea mays
MSTNSRSNSRANFNNEIHDIGTAQNSSMPPTYYDRSLADIFPPHLLKKVVSEVVSTFLLVFVTCGAAGIYGSDKDRISQLGQSVAGGLIVTVMIYAVGHISGAHMNPAVTLAFAVFRHFPWIQVPFYWAAQFTGSICASFVLKAVLHPIAVLGTTTPTGPHWHSLVIEIIVTFNMMFVTLAVATDTRAVGELAGLAVGSAV

SEQ ID NO: 1806 - protein, 76 aa, Zea mays
MPPVKAEDLVVHAVKEQFAGLDYCITSPPPWITTVLVGFQHYLVMLGTTVLIATIIVPLMGGGHAEKAIVIQTILF

SEQ ID NO: 1807 - protein, 201 aa, Solanum lycopersicum
WFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLIGFNMLAEKFKYDDPLEAAQLHGGCGAWGIIFTGLFAKGEFVDQVYPGKPGRPHGLFMGGGGKLLGAHIIQILVIIGWVSATMGPLFYILHKFKLLRISSE

SEQ ID NO: 1808 - protein, 226 aa, Zea mays
MSTATGVRAGRRFTVGRSEDATHPDTIRAAISEFIATAIFVFAAEGSVLSLGKMYHDHSTISTAGGLVAVALAHALGLAVAVAVAVNVSGGHVNPAVTFGALVGGRVSLVRAVLYWAAQLLGAVAATLLLRLATGGARPPGFALASGVGDGHAVLLEAVMTFGFVYAYYATVVDPKRGHLGTIAPLAVGFLLGANVLAGGPFDGAGMNPARVFGPALVGWRWRHHW

SEQ ID NO: 1809 - protein, 101 aa, Oryza sativa
MAVVTAMLSSYVVTTIEEASESMGIPVRFISIILLPIVGNAAEHAGAIIFAFKNKIDISLGITLGSATQISMLVVPVILIVSWVNAIPMDLDFNLLETGSL

SEQ ID NO: 1810 - protein, 201 aa, Oryza sativa
VGGVAGLWGALIEGPRIGRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFM

SEQ ID NO: 1811 - protein, 176 aa, Solanum lycopersicum
VNQSYPVVLEIIFYIGFFIAFAVKSPIIPLHTWLPDTHGEAHYSTCMLLAGILLKMGAYGLIRINMELLPHAHSIFSPWLMIIGTIQIIYAASTSLGQRNLKKRIAYSSVSHMGFIIIGISSLTDTGLNGALLQIISHGFIGAALFFLAGTTYDRIRLVYLDEMGGIAIPMPKMFT

SEQ ID NO: 1812 - protein, 176 aa, Oryza sativa
FGFNPGSFTTISKIYGESGTIDGQWSAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGIIFTALFARREYVELIYGVPGRPYGLFMGGGGRLLAAHIVQILVIVGWVSA

SEQ ID NO: 1813 - protein, 226 aa, Zea mays
MSTGVRPGRRFTVGRSEDATHPDTIRAAISEFIATAIFVFAAEGSVLSLGKMYHDMSTAGGLVAVALAHALALAVAVAVAVNISGGHVNPAVTFGALVGGRVSLVRAVLYWVAQLLGAVAATLLLRLATGGMRPPGFALASGVGDWHAVLLEAVMTFGLMYAYYATVIDPKRGHVGTIAPLAVGFLLGANVLAGGPFDGAGMNPARVFGPALVGWRWRHHWVYWLG

SEQ ID NO: 1814 - protein, 176 aa, Zea mays
MAAASTTSRTNSRVNYSNEIHDLSTVQSGSVVPTLFYPDKSIADIFPPHLGKKVISEVVATFLLVFVTCGAASIYGEDNRRISQLGQSVAGGLIVTVMIYATGHISGAHMNPAVTLSFACFRHFPWIQVPFYWAAQFTGAMCAAFVLKAVLHPIAVIGTTTPSGPHWHALLIEIVV

SEQ ID NO: 1815 - protein, 151 aa, Zea mays
LARKLSLTRALFYIIMQCLGAVCGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYH

SEQ ID NO: 1816 - protein, 201 aa, Zea mays
APLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPI

SEQ ID NO: 1817 - protein, 176 aa, Zea mays
HFNPAVTLAFATSGRFPWRQLPAYVLAQMLGATLASGTLRLMFGGRHEHFPGTLPTGSEVQSLVIEIITTFYLMFVISGVATDNRAIGELAGLAVGATILLNVLIAGPVSGASMNPARSVGPALVSGEYTSIWVYVVGPVVGAVAGAWAYNLIRFTNKPLREITKSTSFLKSTSRM

SEQ ID NO: 1818 - protein, 126 aa, Zea mays
VVKGFQEGLYMGAGGGANAVNPGYTKGDGLGAEIVGTFVLVYTVFSATDAKRSARDSHVPILAPLPIGFAVFLVHLATIPITGTGINPARSLGAAIVYNRSHAWNDHWIFWVGPFIGAALAAIYHV

SEQ ID NO: 1819 - protein, 76 aa, Oryza sativa
SVILLPIVGNAAEHASAIMFAMKDKLDITLGVAIGSSTQISMFVIPFCVVIGWMMGQKMDLNFQLFETATLFITVL

SEQ ID NO: 1820 - protein, 101 aa, Zea mays
FWASSHSSLAPTVEIGGIWPPKGIGVLDPWEIPLLNTPILPSSGAAVTWAHHAILAGKEKRAVYALVATVLLALVSTGFQGMEYYQAPSTISDSIYGSTFL

SEQ ID NO: 1821 - protein, 76 aa, Zea mays
MNITPCSIKTLKGLYDISGVEVGQHFYWQIGGFQIHAQVLITSWVVITILLGSVIIAVRNPQTIPTDGQNFFEYVL

SEQ ID NO: 1822 - protein, 76 aa, Zea mays
APLIDAEELTQWSLYRAVIAEFIATLLFLYITVATVIGYKHQTDASASGPDAACGGVGILGIAWAFGGMIFILVYC

SEQ ID NO: 1823 - protein, 76 aa, Oryza sativa
MNIIPCSIKTLKGLYDISGVEVGQHFYWQIGGFQIHAQVLITSWVVITILLGSVIIAVRNPQTIPTDGQNFFEYVL

SEQ ID NO: 1824 - protein, 151 aa, Zea mays
GLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAA

SEQ ID NO: 1825 - protein, 176 aa, Solanum lycopersicum
MNVLSCSINTLKGLYDISGVEVGQHFYWQIGGFQVHGQVLITSWVVIAILLGSATIAVRNPQTIPTGGQNFFEYVLEFIRDVSKTQIGEEYGPWVPFIGTMFLFIFVSNWSGALLPWKIIQLPHGELAAPTNDINTTVALALLTSVAYFYAGLTKRGLGYFGKYIQPTPILLPINI

SEQ ID NO: 1826 - protein, 226 aa, Oryza sativa
LIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGI

SEQ ID NO: 1827 - protein, 126 aa, Solanum lycopersicum
LYGSSGGEIELQEIVNGLINTQMYNSPGISIALIFITVGIGFKLSPAPSHQWTPDVYEGSPTPVVAFLSVTSKVAASASATRIFNIPFYFSSNEWHLLLEILAILSMILGNLIAITQTSMKRMLAY

SEQ ID NO: 1828 - protein, 126 aa, Solanum lycopersicum; identical to SEQ ID NO: 1827

SEQ ID NO: 1829 - protein, 126 aa, Solanum lycopersicum
MEQTYEYAWIIPFIPLPVPMLIGAGLILFPTATKRFRRMWAFQSVLLLSIVMIFSIYLSIQQINSSSVYQYVWSWIINNDFSLDFGYLIDPLTSIMSILITTVGIMVLIYSDNYMAHDQGYLRFFA

SEQ ID NO: 1830 - protein, 126 aa, Oryza sativa
QTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTM

SEQ ID NO: 1831 - protein, 201 aa, Zea mays
APLIDIDELGKWSLYRAVIAEFVATLLFLYITVATVIGYKHQTDASASGPDAACSGVGILGIAWAFGGMIFILVYCTAGISGGHINPAVTFGLFLARKVSLVRALLYMAAQSLGAICGVALVKGFQSGFYARYGGGANEVSAGYSTGTGLAAEIIGTFVLVYTVFSATDPKRNARDSHVPVLAPLPIGFAVFMVHLATIPI

SEQ ID NO: 1832 - protein, 76 aa, Oryza sativa
KSIINTLIFNSFVFCQVFNEINSREMQKINVFRGIISNWIFIAVIAATVAFQVVIIEFLGTFASTVPLNWQHWLLS

SEQ ID NO: 1833 - protein, 101 aa, Oryza sativa
MLSYYLVDAIDGASKAWNIPVAFISVVLLPVVGNSAGHANAVMFAVKDKLDISLGVAIGSSIQISMFGIPFCVVMGWMMGKPMDLNFHLFETASLLTTVLV

SEQ ID NO: 1834 - protein, 226 aa, Zea mays
QLQPIFAQWIQNIHAGAPGVTAPGATTSTSLTWGGGELVAIGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGTISDQGIVTHITGGNFAQSSITINGWLRDFLWAQASQVIQSYGSSLSAYGLFFLGAHFVWAFSLMFLFSGRGYWQELIESIV

SEQ ID NO: 1835 - protein, 226 aa, Zea mays
LHIFRGLYHASYSSPREFVWCLGVVIFLLMIVTAFIGYVPPWGQMSFWGATVITSLASAIPVVGDTIVTWLWGGFSVDNATLNRFFSLHHLLPLILAGASLLHLAALHQYGSNNPLGVHSEMDKIASYPYFYVKDLVGRVASAIFFSIWIFFAPNVLGHPDNYIPANPMPTPPHIVPEWYFLPIHAILRSIPDKAGGVAAIAPVFISLLALPFFKEMYVRSSSFRP

SEQ ID NO: 1836 - protein, 226 aa, Solanum lycopersicum
LQPVFAQWIQNTHALAPGATAPGATASTSLTWGGGDLVAVGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGSVSDQGVVTHITGGNFAQSSITINGWLRDFLWAQASQVIQSYGSSLSAYGLFFLGAHFVWAFSLMFLFSGRGYWQELIESIVW

SEQ ID NO: 1837 - protein, 76 aa, Zea mays
MTNLVRWLFSTNHKDIGTLYFIFGAIAGVMGTCFSVLIRMELARPGDQILGGNHQLYNVLITAHAFLMIFFMVMPA

SEQ ID NO: 1838 - protein, 226 aa, Zea mays
TYIYPAVAIILSPRYALLIDPLERFVFTMRSLQGALIIAGVFQAVVGFFGIWRVFIRFLSPLAAVPFVTLTGLGLFFFAFPGVTKCIEVGLPALVLLVIFAEYASHLFAKGSFVFSRCAVLVTVVIIWIYAEILTAAGAYNERGPVTQFSCRADRSGIIQGSPWVRFPYPFQWGYPIFCFQDCFAMLAASFASLIESTGTLIAVSRYSGATFCPPSVFSRGIGWEG

SEQ ID NO: 1839 - protein, 276 aa, Zea mays
MTIRNQRFSLLKQPIYSTLNQHLIDYPTPSNLSYWWGFGCLAGICLVIQIVTGVFLAMHYTPHVDLAFNSVEHIMRDVEGGWLLRYMHANGASMFLIVVHLHIFRGLYHASYSSPREFVWCLGVVIFLLMIVTAFIGYVPPWGQMSFWGATVITSLASAIPVVGDTIVTWLWGGFSVDNATLNRFFSLHHLLPLILAGASLLHLAALHQYGSNNPLGVHSEMDKIASYPYFYVKDLVGRVASAIFFSIWIFFAPNVLGHPDNYIPANPMPTPPHIV

SEQ ID NO: 1840 - protein, 276 aa, Zea mays
MPPVKAEDLVVHAVKEQFAGLDYCITSPPPWITTVLVGFQHYLVMLGTTVLIATIIVPLMGGGHAEKAIVIQTILFLSGINTLLQVHFGTRLPAVMSGSYTYIYPAVAIILSPRYALLIDPLERFVFTMRSLQGALIIAGVFQAVVGFFGIWRVFIRFLSPLAAVPFVTLTGLGLFFFAFPGVTKCIEVGLPALVLLVIFAEYASHLFAKGSFVFSRCAVLVTVVIIWIYAEILTAAGAYNERGPVTQFSCRADRSGIIQGSPWVRFPYPFQWGYP

SEQ ID NO: 1841 - protein, 276 aa, Zea mays
EKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDMDSTNVYAYISIIALIVCIPPALIFEGPKLMQHGFSDAIAKVGLTKFVSDLFLVGLFYHLYNQIATNTLERVAPLTHAVGNVLKRVFVIGFSIIVFGNKIS

SEQ ID NO: 1842 - protein, 76 aa, Zea mays
SLPVLAGAITMLLTDRNFNTTFFDPAGGGDPILYQHLFWFFGHPEVYILILPGFGIISHIVSTFSRKPVFGYLGMV

SEQ ID NO: 1843 - protein, 176 aa, Zea mays
SELSSWSFYRAGIAEFVATFLFLYVTVLTVMGVSKSPSKCGTVGIQGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFA

SEQ ID NO: 1844 - protein, 151 aa, Zea mays
SISVVIFHFSWKMQSDVWGTISDQGIVTHITGGNFAQSSITINGWLRDFLWAQASQVIQSYGSSLSAYGLFFLGAHFVWAFSLMFLFSGRGYWQELIESIVWAHNKLKVAPATQPRALSIIQGRAVGVTHYLLGGIATTWAFFLARIIAVG

SEQ ID NO: 1845 - protein, 101 aa, Oryza sativa
LIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWF

SEQ ID NO: 1846 - protein, 126 aa, Oryza sativa
VMDYSGGYVIHLSSGVAGFTAAYWVGPRSTKDRERFPPNNVLLMLTGAGILWMGWAGFNGGDPYSANIDSSLAVLNTNICAATSLLVWTCLDVIFFKKPSVIGAVQGMITGLVCITPGAGLVQGWA

SEQ ID NO: 1847 - protein, 201 aa, Zea mays
PAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIP

SEQ ID NO: 1848 - protein, 76 aa, Zea mays
PVLAPLPIGFAVFMVHLATIPITGTGINPARSLGAAVIYNNDKAWDDHWIFWVGPFIGAAIAAAYHQYVLRASAAK

SEQ ID NO: 1849 - protein, 101 aa, Solanum lycopersicum
NPVKMRGHNATLVVLGTLLLWFGWFGFNPGSFNKILVAYPHMADQGNWTSVGRTAVTTTLAGSTAGIVTLFGRRLLVGHWDAMDVCNGVLGGFVAITSGCS

SEQ ID NO: 1850 - protein, 126 aa, Zea mays
MAKLHRLISAVLRLAAAGAAAAAAVIMVTSHETTSLFGIEMEAKYSYTPSFVFFVVAFAVTFAYSLLAAVLVRPGTTASRLVLLSDVTVGMLLTGAVAATGAISQVGKSGNEHAGWLPICAQVQAY

SEQ ID NO: 1851 - protein, 226 aa, Oryza sativa
VMDYSGGYVIHLSSGVAGFTAAYWVGPRSTKDRERFPPNNVLLMLTGAGILWMGWAGFNGGDPYSANIDSSLAVLNTNICAATSLLVWTCLDVIFFKKPSVIGAVQGMITGLVCITPGAGLVQGWAAIVMGILSGSIPWFTMMVVHKRSRLLQQVDDTLGVFHTHAVAGFLGGATTGLFAEPVLCSLFLPVTNSRGAFYPGRGGGLQFVRQVAGALFIICWNVVVT

SEQ ID NO: 1852 - protein, 76 aa, Oryza sativa
TALLSGYVVSTIEAASESWELSVSFISIILLPIVGNAAEHAGAVIFALKNKMDITLGVSLGSATQISMFVVPVSVI

SEQ ID NO: 1853 - protein, 101 aa, Oryza sativa
SGSIPWYTMMVLHKKWSFMQRIDDTLGVFHTHAVAGFLGGATTGLFAEPILCSLFLSIPDSKGAFYGGPGGSQFGKQIAGALFVTAWNIVITSIICVIISL

SEQ ID NO: 1854 - protein, 176 aa, Zea mays
MTIRNQRFSLLKQPIYSTLNQHLIDYPTPSNLSYWWGFGCLAGICLVIQIVTGVFLAMHYTPHVDLAFNSVEHIMRDVEGGWLLRYMHANGASMFLIVVHLHIFRGLYHASYSSPREFVWCLGVVIFLLMIVTAFIGYVPPWGQMSFWGATVITSLASAIPVVGDTIVTWLWGGFS

SEQ ID NO: 1855 - protein, 276 aa, Zea mays
AEYASHLFAKGSFVFSRCAVLVTVVIIWIYAEILTAAGAYNERGPVTQFSCRADRSGIIQGSPWVRFPYPFQWGYPIFCFQDCFAMLAASFASLIESTGTLIAVSRYSGATFCPPSVFSRGIGWEGISIILDGMCGTLTGTAASVENAGLLAVTRVGSRRVIKISALFMIFFSLFAKFGAVLASIPLPIFAALYCVLFAYSAGAGFSLLQYCNLNSLRTKFILSISLFLGLSIPQYFRVYEMFFGFGPVHTHSVAFNVMVNVIFSSPATVAAILAY

SEQ ID NO: 1856 - protein, 151 aa, Oryza sativa
ALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGW

SEQ ID NO: 1857 - protein, 76 aa, Oryza sativa
LVDAIQGASESLNMPVAFISVILLPIVGNAAEHASAIMFAMKDKLDITLGVAIGSSTQISMFVIPFCVVIGWIMGQ

SEQ ID NO: 1858 - protein, 176 aa, Zea mays
SFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQEGLYMGAGGGANAVNPGYTKGDGLGAEIVGTFVLVYTVFSATDAKRSARDSHVPILAPLPIGFAVFLVHL

SEQ ID NO: 1859 - protein, 151 aa, Oryza sativa
AGFTAAYWVGPRLKSDRERFSPNNILLMIAGGGLLWMGWAGFNGGAPYAANIAASVAVLNTNVCAATSLLMWTCLDVIFFRKPSVIGAVQGMMTGLVCITPGAGLVQTWAAVVMGIFAGSVPWFTMMILHKKSALLMKVDDTLAVFHTHAV

SEQ ID NO: 1860 - protein, 76 aa, Oryza sativa
MEKINVFSGIFSSWIFSAVVGVTAGFQVIMVELLGTFANTVHLSGKLWLTSVLIGSVGLVIGAILKCIPVESGSDA

SEQ ID NO: 1861 - protein, 76 aa, Zea mays
PAPLIDAAELGSWSLYRAVIAEFIATLLFLYITVATVIGYKHQTDASASGADAACGGVGVLGIAWAFGGMIFVLVY

SEQ ID NO: 1862 - protein, 176 aa, Oryza sativa
ERFPPNNILLVLAGAGLLWLGWTGFNGGDPYSANIDSSMAVLNTHICASTSLLVWTILDVFFFGKPSVIGAVQGMITGLVCITPGAGLVQGWAAIVMGILSGSIPWYTMMVLHKKWSFMQRIDDTLGVFHTHAVAGFLGGATTGLFAEPILCSLFLSIPDSKGAFYGGPGGSQFGK

SEQ ID NO: 1863 - protein, 126 aa, Oryza sativa
AFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGF

SEQ ID NO: 1864 - protein, 276 aa, Zea mays
SLPVLAGAITMLLTDRNFNTTFFDPAGGGDPILYQHLFWFFGHPEVYILILPGFGIISHIVSTFSRKPVFGYLGMVYAMISIGVLGFLVWAHHMFTVGLDVDTRAYFTAATMIIAVPTGIKIFSWIATMWGGSIQYKTPMLFAVGFIFLFTIGGLTGIVLANSGLDIALHDTYYVVAHFHYVLSMGAVFALFAGFYYWVGKIFGRTYPETLGQIHFWITFFGVNLTFFPMHFLGLSGMPRRIPDYPDAYAGWNALSSFGSYISVVGIRRFFVVVAI

SEQ ID NO: 1865 - protein, 76 aa, Zea mays
PAPLVDAAELGSWSLYRAVIAEFIATLLFLYVTVATVIGYKHQTDASASGAGADAACGGVGVLGIAWAFGGMIFVL

SEQ ID NO: 1866 - protein, 101 aa, Zea mays
GLFYWVAQLLGASVACLLLRFVTHGKAIPTHGVSGGTTELEGVVFEIVITFALVYTVYATAADPKKGSLGTIAPIAIGFIVGANILAAGPFSGGSMNPARS

SEQ ID NO: 1867 - protein, 276 aa, Oryza sativa
AWQMTSATLVGLQSMPGLVILYGSIVKKKWAINSAFMALYAFAAVWICWVVWAYNMSFGDRLLPFWGKARPALGQSFLVAQSELTATAIRYHNGSAEAPMLKPLYPVATMVYFQCMFASITIIILAGSLLGRMNIKAWMAFVPLWITFSYTVCAFSLWGGGFLFQWGVIDYSGGYVIHLSSGIAGLTAAYWVGPRSASDRERFPPNNILLVLAGAGLLWLGWTGFNGGDPYSANIDSSMAVLNTHICASTSLLVWTILDVFFFGKPSVIGAVQGMI

SEQ ID NO: 1868 - protein, 226 aa, Oryza sativa
MSSSATVVPLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQ

SEQ ID NO: 1869 - protein, 176 aa, Zea mays
SLPVLAGAITMLLTDRNFNTTFFDPAGGGDPILYQHLFWFFGHPEVYILILPGFGIISHIVSTFSRKPVFGYLGMVYAMISIGVLGFLVWAHHMFTVGLDVDTRAYFTAATMIIAVPTGIKIFSWIATMWGGSIQYKTPMLFAVGFIFLFTIGGLTGIVLANSGLDIALHDTYYVV

SEQ ID NO: 1870 - protein, 176 aa, Zea mays
EKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDM

SEQ ID NO: 1871 - protein, 226 aa, Oryza sativa
CGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRVDDTLGVFHTHGVAGLLGGLLTGLFAEPTLCNLFLPVADSRGAFYGGAGGAQFGKQIAGGLFVVAWNVAVTSLICL

SEQ ID NO: 1872 - protein, 251 aa, Oryza sativa
IGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVGGVAGLWGALIEGPRIGRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALA

SEQ ID NO: 1873 - protein, 76 aa, Zea mays
GILYWVAQLLGASVACFLLQYVTHGQAIPTHGVSGISEIEGVVMEIVITFALVYTVYATAADPKKGSLGTIAPMAI

SEQ ID NO: 1874 - protein, 151 aa, Zea mays
MASNNLLVDLKRCFSAPSLRSYLAEFISTFLFVFTAVGSAISARMLTTPDVTSSAGPLVATAVAQAFGLFAAVLIAADVSGGHVNPAVTFAYAIGGRIGVPSAMFYWASQLLGATFACLSLNLFSAGEEVPTTRIAVAMTGFGGAVLEGVL

SEQ ID NO: 1875 - protein, 251 aa, Oryza sativa
ALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRV

SEQ ID NO: 1876 - protein, 76 aa, Solanum lycopersicum
MNVLSCSINTLKGLYDISGVEVGQHFYWQIGGFQVHGQVLITSWVVIAILLGSATIAVRNPQTIPTGGQNFFEYVL

SEQ ID NO: 1877 - protein, 101 aa, Oryza sativa
LKPLYPVATMVYFQCMFASITIIILAGSLLGRMNIKAWMAFVPLWITFSYTVCAFSLWGGGFLFQWGVIDYSGGYVIHLSSGIAGLTAAYWVGPRSASDRE

SEQ ID NO: 1878 - protein, 226 aa, Solanum lycopersicum
YQWAFAIAVAGITSGSIAERTQFTAYLVFSFFLTGFVYPVVAHWLWSSNGWLSPNSTYLLFGSGAIDFAGSGVVHLVGGIAGFWGSIVEGPRVGRFDAFGNPVKMRGHNATLVVLGTLLLWFGWFGFNPGSFNKILVAYPHMADQGNWTSVGRTAVTTTLAGSTAGIVTLFGRRLLVGHWDAMDVCNGVLGGFVAITSGCSVVEPWAAILCGFCAAWVLIGLNILA

SEQ ID NO: 1879 - protein, 76 aa, Zea mays
VDTRAYFTAATMIIAVPTGIKIFSWIATMWGGSIQYKTPMLFAVGFIFLFTIGGLTGIVLANSGLDIALHDTYYVV

SEQ ID NO: 1880 - protein, 226 aa, Oryza sativa
AFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALA

SEQ ID NO: 1881 - protein, 101 aa, Zea mays
GVFYWVAQLLGATVACLLLGFVTHGKAIPTHAVAGISELEGVVFEVVITFALVYTVYATAADPKKGSLGTIAPIAIGFIVGANILAAGPFSGGSMNPARSF

SEQ ID NO: 1882 - protein, 201 aa, Solanum lycopersicum
TQFVAYLIYSSFLTGFVYPVVSHWFWTPDGWASPTNSNLLFGSGVIDFAGSGVVHMVGGIAGFYGALIEGPRIGRYDHTGRSVALRGHSASLVVLGTFLLWFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLI

SEQ ID NO: 1883 - protein, 151 aa, Oryza sativa
MAKVHRLMNAVLRLAAAAAAATAAVVMVTSRETTSFFGIQMEAKYSYTPSFIFFVVAYAVAAAYSLLVLAVPAGSALSRLALTTDVVLGMVLAGAVASAGAISDIAKNGNSHAGWLPVCGQIHAYCNHVMAALIAGFVALAVHFVVVMYSL

SEQ ID NO: 1884 - protein, 226 aa, Zea mays
QGGSAAAAAAALFYPDSKSIADIFPPHLGKKVISEVVATFLLVFVTCGAASIYGEDNARISQLGQSVAGGLIVTVMIYATGHISGAHMNPAVTLSFACFRHFPWIQVPFYWAAQFTGAMCAAFVLKAVLQPIAVIGTTTPSGPHWHALAIEIVVTFNMMFVTCAVATDSRAVGELAGLAVGSAVCITSIFAGPVSGGSMNPARTLAPAVASNVFTGLWIYFLGPVV

SEQ ID NO: 1885 - protein, 76 aa, Oryza sativa
VIGAVQGMITGLVCITPGAGLVQGWAAIVMGILSGSIPWFTMMVVHKRSRLLQQVDDTLGVFHTHAVAGFLGGATT

SEQ ID NO: 1886 - protein, 126 aa, Oryza sativa
CGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVM

SEQ ID NO: 1887 - protein, 101 aa, Zea mays
SGAHMNPAVTLAFAVFRHFPWIQVPFYWAAQFTGSICASFVLKAVLHPIAVLGTTTPTGPHWHSLVIEIIVTFNMMFVTLAVATDTRAVGELAGLAVGSAV

SEQ ID NO: 1888 - protein, 226 aa, Zea mays
MPVSRIAVGAPGELSHPDTAKAAVAEFISTLIFVFAGSGSGMAFSKLTDGGAATPAGLIAASLAHALALFVAVSVGANISGGHVNPAVTFGAFVGGNISLLKALVYWVAQLLGSVVACLLLKIATGGAALGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAG

SEQ ID NO: 1889 - protein, 76 aa, Zea mays
SELSSWSFYRAGIAEFVATFLFLYVTVLTVMGVSKSPSKCGTVGIQGIAWAFGGMIFALVYCTAGVSGGHINPAVT

SEQ ID NO: 1890 - protein, 201 aa, Oryza sativa
LKPLYPVATMVYFQCMFASITIIILAGSLLGRMNIKAWMAFVPLWITFSYTVCAFSLWGGGFLFQWGVIDYSGGYVIHLSSGIAGLTAAYWVGPRSASDRERFPPNNILLVLAGAGLLWLGWTGFNGGDPYSANIDSSMAVLNTHICASTSLLVWTILDVFFFGKPSVIGAVQGMITGLVCITPGAGLVQGWAAIVMGILS

SEQ ID NO: 1891 - protein, 126 aa, Zea mays
LKALVYWVAQLLGSVVACLLLKIATGGAALGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAG

SEQ ID NO: 1892 - protein, 226 aa, Zea mays
MVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGG

SEQ ID NO: 1893 - protein, 226 aa, Zea mays
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGG

SEQ ID NO: 1894 - protein, 226 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGL

SEQ ID NO: 1895 - protein, 226 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGL

SEQ ID NO: 1896 - protein, 126 aa, Zea mays
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTG

SEQ ID NO: 1897 - protein, 151 aa, Zea mays
ATGHISGAHMNPAVTLSFACFRHFPWIQVPFYWAAQFTGAMCAAFVLKAVLHPIAVIGTTTPSGPHWHALLIEIVVTFNMMFVTCAVATDSRAVGELAGLAVGSAVCITSIFAGPVSGGSMNPARTLAPAVASNVFTGLWIYFLGPVIGTL

SEQ ID NO: 1898 - protein, 76 aa, Zea mays
SFYRAGIAEFVATFLFLYISILTVMGVSKSSSKCATVGIQGIAWSFGGMIFALVYCTAGISGGHINPAVTFGLFLA

SEQ ID NO: 1899 - protein, 126 aa, Zea mays
HFPWIQVPFYWAAQFTGAMCAAFVLKAVLQPIAVIGTTTPSGPHWHALAIEIVVTFNMMFVTCAVATDSRAVGELAGLAVGSAVCITSIFAGPVSGGSMNPARTLAPAVASNVFTGLWIYFLGPVV

SEQ ID NO: 1900 - protein, 101 aa, Zea mays
VLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMC

SEQ ID NO: 1901 - protein, 101 aa, Zea mays
VLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMC

SEQ ID NO: 1902 - protein, 101 aa, Zea mays; identical to SEQ ID NO: 1901

SEQ ID NO: 1903 - protein, 101 aa, Zea mays; identical to SEQ ID NO: 1901

SEQ ID NO: 1904 - protein, 101 aa, Zea mays; identical to SEQ ID NO: 1901

SEQ ID NO: 1905 - protein, 101 aa, Zea mays
VLDNEALYDICFRTLKLTTPSFGDLNHLISATMSGVTCCLRFPGQLNSDLRKLAVNLIPFPRLHFFMVGFAPLTSRGSQQYRSLTVPELTQQMWDSKNMMC

SEQ ID NO: 1906 - protein, 101 aa, Solanum lycopersicum
PWLDGSLPGDFGFDPLGLASDPESLRWNQQAELVHCRWAMLGAAGIFIPELLTKIGILNTPSWYTAGEQEYFTDTTTLFIVELVLIGWAEGRRWADIIKPG

SEQ ID NO: 1907 - protein, 101 aa, Solanum lycopersicum
PKKSWIPAVKSGGNLVDPEWLDGSLPGDFGFDPLGLGKDPAFLKWYREAELIHGRWAMAAVLGIFVGQAWSGIPWFEAGADPGAIAPFSFGSLLGTQLLLM

SEQ ID NO: 1908 - protein, 151 aa, Oryza sativa
LIHKEEFQLALFRNSNKKNLFANRIFDLFDLKRNGVIDFGEFVRSLSIFHPETPLGDKIAFAFRLYDLRGTGCIEREELHEMVLALLNESDLFLSEEAVEQIVDQTFKQADLNDDGKIDPDEWKTFASKNPALLKNMTLPYLKDITMVFPS

SEQ ID NO: 1909 - protein, 76 aa, Zea mays
DLMIKAKMLEALQDIEIASKIVGFDSDSDESLDDKYMKLHCDITPLAHDSEDYKLIEQYLLNTHAPTHKDWSLELE

SEQ ID NO: 1910 - protein, 126 aa, Solanum lycopersicum
VTKDMELANLKEYLQFHEGGLSKTELESFGSLMSQNELESMDFRKCMTLSDVFMEHGKMGEFLDGLRSLAKDEFKKLKKSIDELRGSNSVSNKISRSEMAKLEGILQEKESGIWVQLDKTLDNIRM

SEQ ID NO: 1911 - protein, 76 aa, Zea mays
ELKEMLLKKYSGCLSRLRSEFLKKRKKGKLPKDARTVLLEWWNTHYRWPYPTEEDKVRLAAMTGLDPKQINNWFIN

SEQ ID NO: 1912 - protein, 201 aa, Oryza sativa
MLQCLEGVKQLCGVLLKCCDLDLKQPKGLEDPEILARETVFSVSEVEALYELFKKISSAVIDDGLINKEEFQLALFKTNKKESLFADRVFDLFDTKHNGILGFEEFARALSVFHPNAPLDEKIDFSFQLYDLKQQGFIERQEVKQMVVATLAESGMNLSDEVIESIIDKTFEEADTKHDGKIDKEEWRNLVLRHPSLLKNM

SEQ ID NO: 1913 - protein, 251 aa, Oryza sativa
CEGNTENFGAELLETLLKMAPTKEEEIKLREFKEETSPIKLGPAEKFLKAVLDIPFAFKRVDAMLYIANFESEVNYLKKSFETLETACDELRNSRLFLKLLEAVLKTGNRMNVGTNRGDAHAFKLDTLLKLVDVKGTDGKTTLLHFVVQEIIRTEGSHLSASNQSTPRTQANPLRDELECKKLGLQVVAGLGNELSNVKKAAAMDSDVLSSYVSKLAGGIEKITEVLRLNEEVKSREDAWRFHDSMQKFLK

SEQ ID NO: 1914 - protein, 176 aa, Zea mays
SEMKSSLAPQLLELMKMLFNVETYRAAMMEFEINMSEMPLGKLSKENIEKGFEALTEIQNLLKDTADQALAVRESLIVAASNRFFTLIPSIHPHIIRDEDDLMIKAKMLEALQDIEIASKIVGFDSDSDESLDDKYMKLHCDITPLAHDSEDYKLIEQYLLNTHAPTHKDWSLELE

SEQ ID NO: 1915 - protein, 151 aa, Oryza sativa
TSEENQGSLSLPNLNAFDIISLSTGFNLSGFFEDTHGHQEERFTTRQPVTTVLGKLKELAKRLKLKVKKKDNGVLRLAAPKEGKKGFLELDAEIFEVTPSFLLVELKKTNGDTMEYRKLVKEDIRPALKDIVWVWQGDEHLNSQSILQGEQ

SEQ ID NO: 1916 - protein, 201 aa, Zea mays
SEVLAAYTNDVVSRSVLGSTHRKKGRNTLFREMTMTNVDLLVGFNLEYYIPRWPLTDLLFRLVCWKVTRHLKRWDALLEEVIHEHVEMRKLSGDKEKESDDFIDIFLSRYEEYGFTMDNVKSLLMNVFEAAIETSYLVLESAMAELMNHRRVMKKLQAEVRAYGAEKKLDMIREDDLSSLPYLKASMKEALRLHPPGPLLL

SEQ ID NO: 1917 - protein, 176 aa, Solanum lycopersicum
KQKISFTYPPSLSTFWKMIKRKIPLLSLQKTLPNELDTQWVSTNKEKSNNLNKEFLNRLEILDKESLSLDILETRTRFCNDDTKKEYVPKMYDPLLNGLYRGTIKKGVSSSIINNTLLENWEKRVRLNRIHTIFLPNIDYQEFEQKAYTIDKKPLSTEIDEFLTLINELGNEAKSS

SEQ ID NO: 1918 - protein, 251 aa, Oryza sativa
TTPRPKLKPLHWDKVRASSDRVMVWDQLKSSSFQVNEEMIETLFICNPANSAPPKEPATRRPVLPTPKTDNKVLDPKKSQNIAILLRALNVSKEQVCDALCEGNTENFGAELLETLLKMAPTKEEEIKLREFKEETSPIKLGPAEKFLKAVLDIPFAFKRVDAMLYIANFESEVNYLKKSFETLETACDELRNSRLFLKLLEAVLKTGNRMNVGTNRGDAHAFKLDTLLKLVDVKGTDGKTTLLHFVVQEI

SEQ ID NO: 1919 - protein, 101 aa, Solanum lycopersicum
NKGNLSPVFSKHQTDLEKDYVESDTKKGKNKKQYKSNTEAELDLFLKRYLLFQLRWNGALNQRMFENIKVYCLLLRLINPTKITISSIQRREMSLDIMLIQ

SEQ ID NO: 1920 - protein, 76 aa, Oryza sativa
YSVLPCWKAGSVLDLVKTMKFMEYPLLEDQLKKLNNALKGLCVTVSHRKTEEKYTVKGLTDKPADQITFKDSKSGQ

SEQ ID NO: 1921 - protein, 201 aa, Solanum lycopersicum
MAERVLTRVHRLRERVDATLCAHRNEILLFLSRIESHGKGILKPHELLAEFDAIRQDDKDKLNEHAFEELLKSTQEAIVLPPWVALAIRLRPGVWEYVRVNVNALVVEELSVPEYLQFKEELVDGASNGNFVLELDFEPFTASFPKPTLTKSIGNGVEFLNRHLSAKMFHDKESMAPLLEFLRAHHYKGKTMMLNDRIHNS

SEQ ID NO: 1922 - protein, 76 aa, Zea mays
MDKLSGSARLMIVSDLDHTMVDHHDEENLSLLRFGALWESVYCEDSLLVFSTGRSPTLYKELRKEKPMLTPDITIM

SEQ ID NO: 1923 - protein, 176 aa, Oryza sativa
VILFVLLAGYLPFHDKNLMDMYKKIGKAEFKCPSWFNTDVRRLLLRILDPNPSTRISMDKIMENPWFRKGLDAKLLRYNLQPKDAIPVDMSTDFDSFNSAPTLEKKPSNLNAFDIISLSTGLDLSGMFEESDKKESKFTSTSTASTIISKIEDIAKGLRLKLTKKDGGLLKMEGSK

SEQ ID NO: 1924 - protein, 76 aa, Solanum lycopersicum
YGLEVFDDVEFDKWVENGTAPALGSSLKLYQEVLKLGFKVFLLTGRSERHRSVTVENLMNAGFHDWHKLILRGSDD

SEQ ID NO: 1925 - protein, 76 aa, Oryza sativa
LKHPWICDNGVATNRALDPSVLPRLKQFSAMNRLKKLSLQIIAERLSEEEIVGLREMFKAMDTKNRSVVTFGELKG

SEQ ID NO: 1926 - protein, 276 aa, Oryza sativa
LHWIKVTRALQGSLWEELQRNDDSQSVSEFDLSELESLFPAAVPKPNDSSKSDSRRKSLGSKPEKVHLIELRRANNTEIMLTKVKMPLPDLVSAALALDQSTLDVDQVENLIKFCPTKEEMELLKNYTGDKENLGKCEQFFLELMKVPRMESKLRVFSFKIQFGSQVADLRKSLNTIDSSCDEIRSSLKLKEIMKKILLLGNTLNQGTARGAAVGFRLDSLLKLTDTRATNNKMTLMHYLCKVLAAKSSQLLDFYMDLVSLEATSKIQLKMLAEEM

SEQ ID NO: 1927 - protein, 151 aa, Oryza sativa
LEAVLKTGNRMNVGTNRGDAHAFKLDTLLKLVDVKGTDGKTTLLHFVVQEIIRTEGSHLSASNQSTPRTQANPLRDELECKKLGLQVVAGLGNELSNVKKAAAMDSDVLSSYVSKLAGGIEKITEVLRLNEEVKSREDAWRFHDSMQKFLK

SEQ ID NO: 1928 - protein, 151 aa, Oryza sativa
ERAALKKIKLDDGKEGFPRQILREIKLLKKLDHENIIRLKEIVVSPGTAHGAGGSDDYMYRGDIYMVFEYMDHDLKKVLHHSTPSQVKYYMEQLLKGLHYCHVNNVLHRDIKGANLLISGGGKLLKLADFGLARPFTRDGSFTNHVITLWY

SEQ ID NO: 1929 - protein, 176 aa, Oryza sativa
SNEDLGVGEFLDLKLLVDWAVNSGFHLVQLLPINDTSVHGMWWDSYPYSSLSVFALHPLYLRVQALSDAIPGDIKDEISQAKKQLDKKDVDYEASLASKLSIARKIFKLEKDKVLNSSSFKQFLSENEEWLKPYAAFCFLRDFFETSDHSQWGRFSQFSKEKLDKLVSEGTLHHDV

SEQ ID NO: 1930 - protein, 251 aa, Zea mays
ELDRKKKSISKQTNRKRVRISKHKEPGIGEALFGWLASRKLIEVKKPVFLFDKKNKKPKNVIYPGYVDCLFDIKDLPFCSTLPMVYPPADWELWPTATAEVSDPYITNLTPLSSYRGGYLTSLQRESGDSPTLLSEKDYGVFDIHIDRERSQPVLSAVKKLQWQPYRINKLVYDFIQKHWSVLVSVGLLRPKNLALFKRKEALRLLSSLLFKHEELSTIYRYSELKSVLLKNIHASTFELYTMKIAEAYLD

SEQ ID NO: 1931 - protein, 76 aa, Solanum lycopersicum
SNTLQNVLRKAEEYLIMLPPETPFFEFEHKFQEIGLEKGWGDTAERVLEMVCMLLDLLEAPDSCTLEKFLGRIPMV

SEQ ID NO: 1932 - protein, 176 aa, Solanum lycopersicum
QYLSNLKKSQKKWFEPLILISRTERSMNRDPDAYRYKWSNGSKSFQEHLEQSVSKQKSRFQVVFDRLRINQYSIDWSEVIDKKDLSKSLRFFLSKSLLFLSKLLLFLSNSLPFFCVSFGNIPIHRSEIYIYEELKGPNDQLCNQLLESIGLQIVHLKKLKPFLLDDHDTSQKSKFL

SEQ ID NO: 1933 - protein, 101 aa, Oryza sativa
FDMGLAKIFNAMMKKDQFMVAEKIAQSKQALLVPLAAAGMDSYMRAYPYIVKLHMLRELEDFNSLLGDESFLEKPFAADDPKFLKLTKDWENRLRCTQPSL

SEQ ID NO: 1934 - protein, 76 aa, Oryza sativa
PRRHLLTTGWSSFVNKKKLVSGDAVLFLRGDDGELRLGVRRATQLKNEAIFKAFSSESSKMRTLSAVADSLKHGSV

SEQ ID NO: 1935 - protein, 101 aa, Zea mays
FDDEQILMHRGKEWKSRYSKPLTLIPKVPKNNLAMTSVMNSSDEVSDANTQVAIREVLRPKMFKLWKSAVDSSLALLLDDAEANNLTPDSLLTLVEEFSVT

SEQ ID NO: 1936 - protein, 276 aa, Oryza sativa
AQQSNPPKKASLKPLHWVKVTRAMQGSLWEDAQKQGNQARAPDIDLSELESLFSTAVATNASEKGGTKRGSAISKPEIVHLVDMRRANNCEIMLTKIKMPLPDMINAILALDTSVLDNDQVENLIKFCPTKEEIEMLKNYNGNKEMLGKCEQFFLELMKVPRVESKLRVFAFRITFSTQVEELRTNLTTINDATKEVKESLKLRQIMQTILTLGNALNQGTARGSAVGFRLDSLLKLSDTRARNNKMTLMHYLCKLLSEKLPELLDFDKDLIHLEA

SEQ ID NO: 1937 - protein, 201 aa, Oryza sativa
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWY

SEQ ID NO: 1938 - protein, 251 aa, Oryza sativa
LPAPPGGRGVVGHGLTRSLGLNSAATARRSTLKPLHWVKVTRAMHGSLWAEIQKQADANSHSEFDVKELESLFAIAPKTKGGSKSDGASKSLGSKPDKVHLIDLRRANNTEIMLTKIKMPLPDMMSAALALDDSVLDADQLENLIKFCPTKEEMELLKNYTGDKETLGKCEQFFLELMKVPRVESKFRIFAFKIQFQSQIRDVRKNLLTVSSACEELRGSEKLKVIMEKILFLGNKLNQGTPRGQALGFRL

SEQ ID NO: 1939 - protein, 201 aa, Oryza sativa
LRETTTTMIDGIRTALRSIGEGEISISAYDTSLVALLKRLDGGDGPQFPSTIDWIVQNQLPDGSWGDASFFMMGDRIMSTLACVVALKSWNIHTDKCERGLLFIQENMWRLAHEEEDWMLVGFEIALPSLLDMAKDLDLDIPYDEPALKAIYAERERKLAKIPRDVLHSMPTTLLHSLEGMVDLDWEKLLKLRCLDGSFHC

SEQ ID NO: 1940 - protein, 151 aa, Oryza sativa
MLIAAKYEEISPPHVEDFCYITDNTYTRQEVVKMESDILKLLEFEMGNPTIKTFLRRFTRSCQEDKKRSSLLLEFMGSYLAELSLLDYGCLRFLPSVVAASVVFVAKLNIDPYTNPWSKKMQKLTGYKVSELKDCILAIHDLQLRKKCSNL

SEQ ID NO: 1941 - protein, 176 aa, Solanum lycopersicum
NVNALVVEELSVPEYLQFKEELVDGASNGNFVLELDFEPFTASFPKPTLTKSIGNGVEFLNRHLSAKMFHDKESMAPLLEFLRAHHYKGKTMMLNDRIHNSNTLQNVLRKAEEYLIMLPPETPFFEFEHKFQEIGLEKGWGDTAERVLEMVCMLLDLLEAPDSCTLEKFLGRIPMV

SEQ ID NO: 1942 - protein, 276 aa, Oryza sativa
RLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPE

SEQ ID NO: 1943 - protein, 126 aa, Oryza sativa
AWCVGWIVKTNAGFRFSLKTAYVAVTYLDRFLARRCVDRDKEWALQLLSVACLSLAAKVEERRPPRLPEFKLDMYDCASLMRMELLVLTTLKWQMITETPFSYLNCFTAKFRHDERKAIVLRAIEC

SEQ ID NO: 1944 - protein, 101 aa, Zea mays
SIRNHLANLNKYRDQRDRPDLTAPESLQLYLDTRVEQLKVATELSLWQEAFRSVEDIHGLMTMVKKMPKPSILVVYYAKLTEIFWISDSHLYHAYAWLKLF

SEQ ID NO: 1945 - protein, 176 aa, Oryza sativa
RWEAIQMIRTRDGILGLSHFKLLKKLGCGDIGSVYLSELSGTKSYFAMKVMDKASLASRKKLLRAQTEKEILQCLDHPFLPTLYTHFETDKFSCLVMEFCPGGDLHTLRQRQRGKYFPEQAVKFYVAEILLAMEYLHMLGIIYRDLKPENVLVREDGHIMLSDFDLSLRCAVSPTL

SEQ ID NO: 1946 - protein, 101 aa, Oryza sativa
NAMISGLFQLGNAYEWVVTKKSGRSSEGDLISLAPKELKHQKTESAPNLDAIAKEQSAPRKDVKKKHNRIYKKELALSLLLLTAAARSLLSKQGIHFYFLL

SEQ ID NO: 1947 - protein, 176 aa, Oryza sativa
HSNLTTICIKELDSLKLQSERMLRASLCDFKDSQKKLKSLWRLHENIIFCLQELGSFGALQAARTFLSFDGDKLDRREVDLNGSTSSFAHHYLNGATSILSRNKTDGSHAGSFDLEKLEEPFFSNKFSVLINVLSRYGLQENMKCIVFVKRITVARAISNILQNLKCLEFWKCEFL

SEQ ID NO: 1948 - protein, 276 aa, Oryza sativa
PPPPPLPLQIQVGKDGSPLPRLKPLHWDKVRAAPNRSMVWNDIRSSSFEFEFDEQMIKSLFAYNLQGSMKDEEAMNKTASTTKHVIEHHRLQNTTILLKTLNANTSQVCNSVIQGNGLSVQQLEALVKMKPTKEEEEKLLNYDGDINMLDPAENFVKVLLTIPMAFPRMEVMLYKENFDDEVAHIKMSFAMIEGACTELKSSKLFLRLLEAVLKTGNRMNVGTLRGGASAFKLDALLKLADIRGTDGKTTLLHFVVKEMARSKGLKALEKLNETPS

SEQ ID NO: 1949 - protein, 76 aa, Oryza sativa
MQPPNQELIVRDLHDNMWTFRHIYRGQPKRHLLTTGWSLFVGAKRLKAGDSVLFIRDEKSQLLLGVRRATRQQTML

SEQ ID NO: 1950 - protein, 101 aa, Zea mays
TSLLSNERFHRCMIACSAELVLATHKTVTMMFPAVLEKTGITAFDLSKVIEGFVRHEDTLPRELKRHLNSLEERLLESMAWEKGSSMYNSLIVARPALSVE

SEQ ID NO: 1951 - protein, 76 aa, Zea mays
SEVLAAYTNDVVSRSVLGSTHRKKGRNTLFREMTMTNVDLLVGFNLEYYIPRWPLTDLLFRLVCWKVTRHLKRWDA

SEQ ID NO: 1952 - protein, 151 aa, Oryza sativa
ICKLLSLTLHADSETDEVYAQMTLQPVNKYDRDAMLASELGLKQNKQPAEFFCKTLTASDTSTHGGFSVPRRAAEKIFPPLDFTMQPPAQELIAKDLHDISWKFRHIYRGQPKRHLLTTGWSVFVSTKRLLAGDSVLFIRDEKSQLLLGIR

SEQ ID NO: 1953 - protein, 76 aa, Zea mays
PREPESMKELREVTAKHPWNLMTTSADEGQFLNMLIKLIGAKKTMEIGVYTGYSLLATALALPEDGTILAMDINRE

SEQ ID NO: 1954 - protein, 76 aa, Solanum lycopersicum
ARKMSSFGLVSTQTQYFLAAMLSDEKFVDNFLRESAMRLGKRHKHFTNGLEVVGIKCLKNNAGLFCWMDLRPLLRE

SEQ ID NO: 1955 - protein, 76 aa, Zea mays
SFLGPPMGKVGSASPTDPKNLAWDPDVLGMKKHKLLKEDILPSMASNRKVQRLLNEFMDLLLEYETDVTLIPQPGT

SEQ ID NO: 1956 - protein, 76 aa, Oryza sativa
TADDLKHKKVNLLVGEPFYLGSEGMLPWQNLRFWSVRTLLDSMLSEDAFIMPCKGILKLCAMSLPDLWRSRSSLKD

SEQ ID NO: 1957 - protein, 76 aa, Solanum lycopersicum
AVWKDLWPIERRRQREFFCFGMDILLKLDLPATRRFFDAFFDLEPRYWHGFLSSRLFLPELIVFGLSLFSHASNTS

SEQ ID NO: 1958 - protein, 226 aa, Solanum lycopersicum
VTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILEDEARLKEVLRFSCACGAITTTKKGAIPALPTASEALTLLKG

SEQ ID NO: 1959 - protein, 101 aa, Oryza sativa
EKQLKIMQQIDEDHTLTQLANAWLDIAVGGSKIREAYLIFQDFAEKYPMTGMVLNGKAVCCMHMGSFDEAETLLLEALNKDAKDPETLANLIVCNLHLGKP

SEQ ID NO: 1960 - protein, 201 aa, Zea mays
MSSLDPSPATSTQQQKQLESLVNLLTQGSRFYRKAYNELFSGVTTEQDPDSSTNIPEYMLFGWHLFLMLHLRSPELFKDLVSCIHGLVAVLAILLIHVPAKFRSFTIEGSSHLIKQTEKGVDLIASLCHNYHTSEERLKEMLHKSHNAIEDIFHMKALSASECKPENLDKIDTDDLMYFKGLIDMECFQSNLEKMEKLCNS

SEQ ID NO: 1961 - protein, 126 aa, Zea mays
FMPVRNVNYSIFSCGNGNEKHEILFLEIWTNGSLTPKEALYEASRNLIDLFLPFLHTEEEGTSFEENKNRLTPPLLTFQKRFTNLKKNKKGIPLNCIFIDQLELPSRTYNCLKRANIHTLLDLLSK

SEQ ID NO: 1962 - protein, 151 aa, Oryza sativa
LPAPPGGRGVVGHGLTRSLGLNSAATARRSTLKPLHWVKVTRAMHGSLWAEIQKQADANSHSEFDVKELESLFAIAPKTKGGSKSDGASKSLGSKPDKVHLIDLRRANNTEIMLTKIKMPLPDMMSAALALDDSVLDADQLENLIKFCPTK

SEQ ID NO: 1963 - protein, 201 aa, Oryza sativa
IFGRDNVGSLHGFMYKYLKTLVLRLYGQENLKSVLLAETDAACRGSLASWASQPSVELKEGISTMIFDLTAKKLIGYDPSKPSQVNLRKNFGAFICGLISFPLNIPGTAYHECMEGRKNAMKVLRGMMKERMAEPERPCEDFFDHVIQELRREKPLLTETIALDLMFVLLFASFETTALALTIGVKLLTENPKVVDALREE

SEQ ID NO: 1964 - protein, 226 aa, Oryza sativa
YVPSIMFRIQCMLLSVKLKVQLGPTVQQFDVPVLKILEALTTKKCQEEFSQESLETLGDSFLKYVTTRHLFSEYRLQHEGILTKMKKNLISNAALCQLACSSNLVGYIHAEEFNPRDWIIPCLDYDERGNKKISFLAPNGMYSQRKMSIKSKRIADSVEALIGAYLSTAGEKAAFLLMKSLGMNIEFHTEIPVERKISMKAEEFIDVRSLEGMLGYKFNDSLLLLE

SEQ ID NO: 1965 - protein, 126 aa, Oryza sativa
KPSFEVTIEDGLFKCTLTLPRNAAFQSIVGPLSSSSNLSKQLVSLEACKKLHQLGELNDHLVPLTEEPMDTDFTTADEKCISGPGTTKRKELHGTTCVLALSGTWIHDSENITLNTYRIDFLCDQE

SEQ ID NO: 1966 - protein, 76 aa, Oryza sativa
LKKLLKKCRSDLQSHENDGSSAGRCPGHCSVCDGSFFPSLLNEMSAVIGCFNEKAKKLLELHLASGFKKYTMWFTS

SEQ ID NO: 1967 - protein, 76 aa, Solanum lycopersicum
FGLVSSQTQYLLSCMLSDKKFTKKYISENQKRLKKRHAMLVKGLKSAGINCLESNAGLFCWVDMRHLLSSNNFDAE

SEQ ID NO: 1968 - protein, 126 aa, Solanum lycopersicum
EKLDLNLPLNLHLVNLVKCKRDSTIKRNVEYMGEGVGELCDWKEMIKLHQRQNGSLFDSPATTAAALIYHQHDQKCYQYLNSIFQQHKNWVPTMYPTKVHSLLCLVDTLQNLGVHRHFKSEIKKAL

SEQ ID NO: 1969 - protein, 76 aa, Oryza sativa
ASGGKDGTTLLWDLTEGKMLYKLDAGAIIHSLCFSPNRYWLCAATEDSVKIWDLESKLVMQDLKPEVQAFKSQMLY

SEQ ID NO: 1970 - protein, 101 aa, Solanum lycopersicum
MDVRRRSEEPVYPSKVFAADEKPLKPHKKQQQQQEDKNTLLIDASDALPLPLYLTTNGLFFTMFFSVMYFLLSRWREKIRNSTPLHVVTLSELGAIVSLIA

SEQ ID NO: 1971 - protein, 151 aa, Oryza sativa
FGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFS

SEQ ID NO: 1972 - protein, 151 aa, Oryza sativa
CHVNNVLHRDIKGANLLISGGGKLLKLADFGLARPFTRDGSFTNHVITLWYRPPELLLGATNYAEAVDIWSVGCIFAEFLLRKPLFPGRTEQEQLSKIFELCGFPNEENWPGVSKLPLYKTIRPTTPTKRRLRDIFHNFDSHAVDLIDRML

SEQ ID NO: 1973 - protein, 151 aa, Zea mays
YGRMNIGSRPAKRRPGGGITTLRAIPWIFSWTQTRFHLPVWLGVGAAFKFAIDKDVRNFQVLKEMYNEWPFFRVTLDLLEMVFAKGDPGIAGLYDELLVAEELKPFGKQLRDKYVETQQLLLQIAGHKDILEGDPFLKQGLVLRNPYITTL

SEQ ID NO: 1974 - protein, 226 aa, Oryza sativa
GTTGAKVTADSSISIVYRYCEKLPQDKCYSPKPTFEFTHHDDGYVCTLALPPSAVLQILVGPKARNMHKAKQLVCLDACKKLHELGALDDHLCLSVEDPVPEIVSKNKGTGIGTTKRKELHGTTRIHAWSGNWVSKKTALKLQSYKMNFVCDQAGQIYSEFVLLIDATLPDEVATLEIDLYLHDKMVKTSVSSCGLLELDAQQMEQAKLFQGLLFNGLFGKLFTRS

SEQ ID NO: 1975 - protein, 126 aa, Zea mays
NIGSRPSKRKPSGGIDSLRAIPWIFAWTQTRFHLPVWLGFGAAFKNVLQKDIRNLHMLQEMYNEWPFFRVTIDLVEMVFAKGNPGIAALYDKLLVSEELHPLGEKLRANYEETQKLLLQVAGHRDL

SEQ ID NO: 1976 - protein, 151 aa, Solanum lycopersicum
LCPKLLRGSASAWERWVFHFAHLRQLPVLVPYIPTENPRLRDTAYEVALVALATNPSFHKDLLSTVKSWPPRIYSTTPVFSAIEPQINTSSMTDPLKEALAELYVIDGQHDKAFALYADLMKPDLFDFIEKHNLHDAVREKVLQLMMIDCK

SEQ ID NO: 1977 - protein, 76 aa, Oryza sativa
RVLESYDFVGFNHYVAIFVRADLSKLDQSLRDYMGDAAVKYDLPFLKSNNEFPLGLTSDFMTSTPWALKKMLNHLQ

SEQ ID NO: 1978 - protein, 76 aa, Solanum lycopersicum
KVSDVELEFLTGSNKIDDESAMSLWHPNLKLLLVTLGEKGCNYYTKKFHGTVGGFHVKTVDTTGAGDSFVGALLTK

SEQ ID NO: 1979 - protein, 226 aa, Solanum lycopersicum
MVPSRHSLNEPCFPQCLDWIIENQREDGSWGLNPTHPLLLKDSLSSTLACLLALTKWRVGDEQIKRGLGFIETYGWAVDNKDQISPLGFEVIFSSMIKSAEKLDLNLPLNLHLVNLVKCKRDSTIKRNVEYMGEGVGELCDWKEMIKLHQRQNGSLFDSPATTAAALIYHQHDQKCYQYLNSIFQQHKNWVPTMYPTKVHSLLCLVDTLQNLGVHRHFKSEIKKAL

SEQ ID NO: 1980 - protein, 176 aa, Zea mays
LLNQLKDQAAVLKENMNIDLRVMGIAGSRTMLLSDIGVDLTQWKEKLQTEAEPANLDKFVHHLSENHFFPNRVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGARTF

SEQ ID NO: 1981 - protein, 76 aa, Oryza sativa
EGKSTKQCSTHLHQLHICLPSSRNKTRLLYRMSLDFAPWIKHVPFMHILWSHFAEKVLNEDLRLVLGQQERMINGA

SEQ ID NO: 1982 - protein, 76 aa, Oryza sativa
FGDIHKSIYFLSWKEQGSQLSLLAKDFGSLDCFATEFLIDGSTLSLVASDSDKNVQIFYYAPKMVESWKGQKLLSR

SEQ ID NO: 1983 - protein, 76 aa, Solanum lycopersicum
GLTMDHPIMKTTEFWTSHECLLLPYEQSLTRRDSTSGLHYDCSAHFLWVGERTRQLDGAHVEFLRGIANPLGIKVS

SEQ ID NO: 1984 - protein, 126 aa, Oryza sativa
PEIVSKNKGTGIGTTKRKELHGTTRIHAWSGNWVSKKTALKLQSYKMNFVCDQAGQIYSEFVLLIDATLPDEVATLEIDLYLHDKMVKTSVSSCGLLELDAQQMEQAKLFQGLLFNGLFGKLFTRS

SEQ ID NO: 1985 - protein, 76 aa, Oryza sativa
KANLPGPPEFLLCVLPERKNCDLYGPWKKKNLHEMGIITQCIVPSVKMNDQYYTNVLLKINAKLGGMNSKLSLEHR

SEQ ID NO: 1986 - protein, 76 aa, Zea mays
DSYIAVLDEVFDKHMTTAKDLLAGEDLARFLSQLHADISNLKAMLRAIYIAGHATESFSDFVVGHGELWSAQMLSY

SEQ ID NO: 1987 - protein, 76 aa, Oryza sativa
LKGIYANRELKLKRIPKDMMHIVPTSILHSLEGMPGLDWQRLLKLQCSDGSFLFSPSATAYALMQTGDKKCFAYID

SEQ ID NO: 1988 - protein, 76 aa, Zea mays
LDTSVYPREPESMKELREITAKHPWNLMTTSADEGQFLNMLIKLIGAKKTMEIGVYTGYSLLATALALPEDGTILA

SEQ ID NO: 1989 - protein, 176 aa, Oryza sativa
AYWRMLRKLCTVELLSTKMVRQLAPIRDGETLALVRNIEAAAGGKKPFTLATLLISCTNTFTAKAAFGQACGGELQEQFLTALDEALKFSNGFCFGDLFPSLRFIDAMTGLRSRLERLRLQLDTVFDKIVAQCESNPGDSLVNVLLRIKDQGELDFPFSSTHVKAIILDMFTGGTE

SEQ ID NO: 1990 - protein, 151 aa, Oryza sativa
DAINRALSLPHGHGHGPKMERRLSLVKQNGGAPGEFDHNRWLFETKGTYGYGNAIWPEDDGVAGHPKELMSKPWRPLTRKLRIQAAVISPYRLLVLIRLVALGLFLMWRIKHQNEDAIWLWGMSIVCELWFALSWVLDQLPKLCPINRATD

SEQ ID NO: 1991 - protein, 101 aa, Oryza sativa
VGCIFAELLTLKPLFQGVEAKATPNPFQLDQLDKIFKVLGHPTVEKWPTLANLPCWQNDQQHIQGHKYENTGLHNIVHLPQKSPAFDLLSKMLEYDPRKRI

SEQ ID NO: 1992 - protein, 76 aa, Zea mays
AIALAEVFEKHMTAAKDLLDGEDLARFLSQLHSDVSNLRAMLRAIYIAGHATESFSDFVVGHGELWSAQMLSYAIK

SEQ ID NO: 1993 - protein, 201 aa, Solanum lycopersicum
MGHKLKIRTPHATTRRLVKDLGPLKVVCIDYPRPELDNTVNYLEAAFLSSTFRASPRPTKPLEIVIAGAGLGGLSTAKYLADAGHKPILLEARDVLGGKVAAWKDDDGDWYETGLHIFFGAYPNIQNLFGELGINDRLQWKEHSMIFAMPSKPGEFSRFDFSEALPAPLNGILAILKNNEMLTWPEKVKFAIGLLPAMLGG

SEQ ID NO: 1994 - protein, 76 aa, Oryza sativa
FLLDLTKEKPAWKEIPTSWSPPSRLGHTLSVFGKTKLFMFGGLAKSGSLRLRSCDAYTMDAGEDSPQWRQLATTGF

SEQ ID NO: 1995 - protein, 151 aa, Zea mays
LNLVAKDGLAVIAGTIEKIKAIVLAVKSSPLQWEELMKCASECDLDKSKGISYDVSTRWNSTYLMLRDALYYKPALIRLKTSDPRRYVCLNCCTCHHYKFSINQMSIIVGTMQFVLKPRSGRWHLTLFKCLKKFFDLTELLSGTQYSTANL

SEQ ID NO: 1996 - protein, 251 aa, Oryza sativa
WRIKALEDSGGWMERTTVEDMDIAVRAHLNGWKFVFLNDVECQCELPESYEAYRKQQHRWHSGPMQLFRLCLPDIIRCKIAFWKKANLIFLFFLLRKLILPFYSFTLFCIILPMTMFIPEAELPDWVVCYIPALMSFLNILPAPKSFPFIIPYLLFENTMSVTKFNAMISGLFQLGSAYEWVVTKKSGRSSEGDLIALAPKELKQQKILDLTAIKEQSMLKQSSPRNEAKKKYNRIYKKELALSLLLLTAA

SEQ ID NO: 1997 - protein, 76 aa, Oryza sativa
STTWLVLDVASTIPSEFARRILPSKLRSYGFFNMLRLWRLRRVSSLFSRLEKDRHFNYFWVRCAKLICVTLFAVHC

SEQ ID NO: 1998 - protein, 126 aa, Solanum lycopersicum
RTYCQPLSDMNLSDSEGKNLHQYLNFNSNMGLIHTPCSEKDLSSEKRKKWSLCLKKCVEKGQTYRTFQRDSAFSTLSKWNLFQTYMPWFLTSTGYKYLNLIFLDTFSDLLPILSSSQKFVSIFPDI

SEQ ID NO: 1999 - protein, 251 aa, Oryza sativa
CTRMHELTKNDHLRKMVCQNAWGRDVTVRLEMSTKMLGWGRLARELTTLEAASWRKFTVGGRVEPSRCNFSACAVGNRLVLFGGEGVNMQPMDDTFVLNLESAKPEWRRVKVSASPPGRWGHTLSWLNGSWLVVFGGCGQQGLLNDVFVLDLDAKQPTWREVASEGPPLPRSWHSSCTLDGSKLVVSGGCTESGVLLSDTFLLDLTKEKPAWKEIPTSWSPPSRLGHTLSVFGKTKLFMFGGLAKSGSLRL

SEQ ID NO: 2000 - protein, 76 aa, Oryza sativa
KLERRTVAYHESGHAVAGWFLEHAEPLLKVTIVPRGTAALGFAQYVPNDNLLMTKEQLFDMTCMTLGGRAAEEVLI

SEQ ID NO: 2001 - protein, 176 aa, Oryza sativa
MALFRKFFFKKPPDGLLLITDNIYVFDHCFSMKEMEEDHFEAHIRGVAAHLLDNFGDHSFMISNFGIRDEESPIYHILSEYGMTVLDYPGHYEGCPLLTMEMVHCILKSSESWLSLGQRNFLIMHCEQGCWPILAFMLAALLIYLGQYSDEQKTLDMLYKQSPVELLEMFSPLNPM

SEQ ID NO: 2002 - protein, 101 aa, Oryza sativa
VFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVV

SEQ ID NO: 2003 - protein, 226 aa, Solanum lycopersicum
RTYCQPLSDMNLSDSEGKNLHQYLNFNSNMGLIHTPCSEKDLSSEKRKKWSLCLKKCVEKGQTYRTFQRDSAFSTLSKWNLFQTYMPWFLTSTGYKYLNLIFLDTFSDLLPILSSSQKFVSIFPDIMHGSGISWRILQKKLCLPQWNLISEISSKCLHNLLLSEEMIHRNNESPLISTHLRSPNAREFLYSILFLLLVAGYLVRTHLLFVSRASSELQTEFERVKS

SEQ ID NO: 2004 - protein, 151 aa, Zea mays
FSGLEYETDGWRQWNLAGCLSSLKRSEPSFSVVLLGELSFALTAGGHDFGFVILGDSSLAETFHSFSSLSRPHTTLKYTFKKLLGLKNQKDQHFSDLIVEQKEELKNRANQLIQTLESCGWEAAIGCGGISMLAKPTAYMGKAFKAAGFDG

SEQ ID NO: 2005 - protein, 76 aa, Zea mays
LLSSRESIHPLSVYGELSLEHRLRFVLNGKMEHLTTHLHRPRTTRSPLSFWGDGGIVPFEPFFHAFPGGLEKAVIN

SEQ ID NO: 2006 - protein, 76 aa, Solanum lycopersicum
WSKTAENFANFTGEQGYPGGKFFDPLALAGTLNNGVYVPDTEKLERLKLAEIKHSRLAMLAMLIFYFEAGQGKTPL

SEQ ID NO: 2007 - protein, 176 aa, Solanum lycopersicum
GNHIEMGLHVFFGCYNNLFRLLKKVGAEKNLLVKEHTHTFVNKGGEIGELDFRFPVGAPLHGINAFLSTNQLKIYDKARNAVALALSPVVRALVDPDGALQQIRDLDNVSFSEWFLSKGGTRASIQRMWDPVAYALGFIDCDNMSARCMLTIFALFATKTEASLLRMLKGSPDVYL

SEQ ID NO: 2008 - protein, 101 aa, Oryza sativa
GFMSAAGLTVDHPLMTSTDFWTSHECLLLPYEQSLTRQDSTTGHFYDCSAHMLWVGERTRQLDGAHVEFLRGVANPLGIKVSDKMNPTELVKLIEILNPSN

SEQ ID NO: 2009 - protein, 176 aa, Oryza sativa
GLGAAVEFNKLNMRYMLDFTCAALFGGEPPSKVVGDGAVTKAMAWLAFQLHPIASKVVKPWPLEELLLHTFSLPPFLVRRGYADLKAYFADAAAAVLDDAEKSHTGIPRDELLDNLVFVAIFNAFGGFKIFLPHIVKWLARAGPELHAKLATEVRATVPTGEDDGITLAAVERMPL

SEQ ID NO: 2010 - protein, 201 aa, Oryza sativa
FVAIFDADFQPTPDFLKKTIPHFEGNPELGLVQARWSFVNKDENLLTRLQNINLCFHFEVEQQVNGVFLNFFGFNGTAGVWRIQALEESGGWLERTTVEDMDIAVRAHLNGWKFIFLNDVKVLCELPESYEAYRKQQHRWHSGPMHLFRLCLPDILTAKISSWKKANLILLFFLLRKLILPFYSFTLFCVILPLTMFVPEA

SEQ ID NO: 2011 - protein, 126 aa, Solanum lycopersicum
AVKQNYGEKVLIQFEDFANHNAFNLLAKYGTSHLVFNDDIQGTASVVLAGLMAALNLVGGSLSEHTFLFLGAGEAGTGIAELIALEMSKQTGIPLEETRKKIWMVDSKGLIVKSRMEMLQHFKRPW

SEQ ID NO: 2012 - protein, 76 aa, Oryza sativa
SLTTATEEKPWWDMLPVVLIQYARGLHRGHKNLFQALPRLLTLWFEFGSIYIQDGSSFNKPMKEVHIRLLGIMRGC

SEQ ID NO: 2013 - protein, 276 aa, Zea mays
EYIYAFAHDYGLNGSEPVEIFGCNNKKFSSLLVNRLIIRMYQQNFLINSVNYPNQDRLLDHRNYFYSEFYSQILSEGFAIVVEIPLSLGQLSCPEEKEIPNFQNLQSIHSIFPFLEDKFLHLHYLSHIKIPYPIHLEILVQLLEYRSQDVPSLHLLRFFLYYYSNWNSFITSMKSIFLLKKENKRLFRFLYNSYVSEYEFFLLFLHKQSSCLRLTSSGTFLERIIFSGKMEHFGVMYPGFFRKTIWFFMDPLMHYVRYQGKAILASKGTLLLKKKW

SEQ ID NO: 2014 - protein, 151 aa, Oryza sativa
FDCCFSTETMEQFEYKNYLDNIVLQLREQFVDSSLMVFNFRDEGKSLVSGLFSLYGITVKDYPCQYLGCPLLPLEMVLHFLRLSERWLMLEGQQNFLLMHCEKGGWPVLAFMLAGLLLYMKQYNGEERTLVMVYKQAPKELLQMLTTLNPQ

SEQ ID NO: 2015 - protein, 151 aa, Oryza sativa
ESAKPEWRRVKVSASPPGRWGHTLSWLNGSWLVVFGGCGQQGLLNDVFVLDLDAKQPTWREVASEGPPLPRSWHSSCTLDGSKLVVSGGCTESGVLLSDTFLLDLTKEKPAWKEIPTSWSPPSRLGHTLSVFGKTKLFMFGGLAKSGSLRL

SEQ ID NO: 2016 - protein, 226 aa, Oryza sativa
VMEYYKAKQRCYALQIRDYCCYLQCHHLLLQQQQHGVAAARLKAAMGRLGLEAATAFNAANYLDRFLSINCHLKWEEWMVEVVSVGCLSLACKLDEVTIPSLHDLQMEEAMGHSFRASTIRDMELTLLKALRWRLACVTPFSFLPVTTTTTTTRALLLRSLLDPSFLRFDASLLAASALTLSSTTPQHPNHLLLNRLIHPFSQTDHEVKECFNMMKALHLDMSKNP

SEQ ID NO: 2017 - protein, 251 aa, Oryza sativa
AVRAHLKGWKFVFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLVGLVEKHSKQQRVGSAPNLDALTKEESNPKKDSKKKKHNRIYRKELALSFLLLTAAARSLLSAQGIHFYFLLFQGVSFL

SEQ ID NO: 2018 - protein, 176 aa, Oryza sativa
NMPPGPFLAGDPRVVALLDARSFRVLLDDSMVDKADTLDGTFMPSLALFGGHRPLAFLDAADPRHAKIKRVVMSLAAARMHHVAPAFRAAFAAMFDEVDAGLVAGGPVEFNKLNMRYMLDFTCAALFGGAPPSKAMGDAAVTKAVKWLIFQLHPLASKVVKPWPLEDLLLHTFRLP

SEQ ID NO: 2019 - protein, 176 aa, Zea mays
NFQNLQSIHSIFPFLEDKFLHLHYLSHIKIPYPIHLEILVQLLEYRSQDVPSLHLLRFFLYYYSNWNSFITSMKSIFLLKKENKRLFRFLYNSYVSEYEFFLLFLHKQSSCLRLTSSGTFLERIIFSGKMEHFGVMYPGFFRKTIWFFMDPLMHYVRYQGKAILASKGTLLLKKKW

SEQ ID NO: 2020 - protein, 176 aa, Oryza sativa
LSPYRLLVLVRFVALFLFLVWRVTNPNMDALWLWGISIVCEFWFAFSWLLDQMPKLNPINRAADLAALKEKFESPSPTNPTGRSDLPGLDVFISTADPYKEPTLVTANTLLSILATEYPVEKLFVYISDDGGALLTFESMAEACAFAKVWVPFCRKHSIEPRNPDSYFTQKGDPTK

SEQ ID NO: 2021 - protein, 176 aa, Oryza sativa
FKGNPELGLVQARWSFVNKDENLLTRLQNINLCFHFEVEQQVNGVYLSFFGFNGTAGVWRIKALEDSGGWMERTTVEDMDIAVRAHLNGWKFIFLNDVKVLCELPESYQAYRKQQHRWHSGPMQLFRLCLPAVFKSKISTWKKANLVMLFFLLRKLILPFYSFTLFCVILPLTMFV

SEQ ID NO: 2022 - protein, 76 aa, Solanum lycopersicum
QNLFGELGINDRLQWKEHSMIFAMPSKPGEFSRFDFSEALPAPLNGILAILKNNEMLTWPEKVKFAIGLLPAMLGG

SEQ ID NO: 2023 - protein, 76 aa, Zea mays
FLLFLHKQSSCLRLTSSGTFLERIIFSGKMEHFGVMYPGFFRKTIWFFMDPLMHYVRYQGKAILASKGTLLLKKKW

SEQ ID NO: 2024 - protein, 126 aa, Oryza sativa
LFETKGTYGYGNAIWPKENEVDNGGGGGGGGGLGGGDGQPAEFTSKPWRPLTRKLKIPAGVLSPYRLLILIRMAVLGLFLAWRIKHKNEDAMWLWGMSVVCELWFGLSWLLDQLPKLCPVNRATDL

SEQ ID NO: 2025 - protein, 151 aa, Oryza sativa
PAWVVCYIPATMSILNILPAPKSFPFIVPYLLFENTMSVTKFNAMISGLFQLGSAYEWVVTKKSGRSSEGDLVGLVEKHSKQQRVGSAPNLDALTKEESNPKKDSKKKKHNRIYRKELALSFLLLTAAARSLLSAQGIHFYFLLFQGVSFL

SEQ ID NO: 2026 - protein, 76 aa, Oryza sativa
DILSEYDMTVMDYPQQYEGCPLLQLEMIHHFLKSCENWLSVEGQHNMLLMHCERGGWPVLAFMLAGLLLYRKTYTG

SEQ ID NO: 2027 - protein, 76 aa, Oryza sativa
YWRMLRKLCTVELLSTKVVRQLAPVRNDETLTLVRNIKAASSGHGGGGGKKPVTLARLLTTCTNTITAKAAFGQAC

SEQ ID NO: 2028 - protein, 251 aa, Solanum lycopersicum
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYL

SEQ ID NO: 2029 - protein, 76 aa, Oryza sativa
VIRMFVLLFYLTWRIRNPNMEALWLWGMSIVCELWFAFSWLLDMLPKVNPVNRSTDLAVLKEKFETPSPSNPHGRS

SEQ ID NO: 2030 - protein, 176 aa, Oryza sativa
FLLDLTKEKPAWKEIPTSWSPPSRLGHTLSVFGKTKLFMFGGLAKSGSLRLRSCDAYTMDAGEDSPQWRQLATTGFPSIGPPPRLDHVAVSLPCGRIIIFGGSIAGLHSPSQLFLLDPAEEKPTWRILNVPGQPPKFAWGHSTCVVGGTRVLVLGGHTGEEWILNELHELCLASRP

SEQ ID NO: 2031 - protein, 101 aa, Oryza sativa
LKPENLLLDSHGALKVSDFGLSAFAPQTKEDGLLHTACGTPNYVAPEVLADKGYDGMAADVWSCGIILFVLMAGYLPFDDPNLMTLYKLICKAKVSCPHWF

SEQ ID NO: 2032 - protein, 276 aa, Zea mays
NFQNLQSIHSIFPFLEDKFLHLHYLSHIKIPYPIHLEILVQLLEYRSQDVPSLHLLRFFLYYYSNWNSFITSMKSIFLLKKENKRLFRFLYNSYVSEYEFFLLFLHKQSSCLRLTSSGTFLERIIFSGKMEHFGVMYPGFFRKTIWFFMDPLMHYVRYQGKAILASKGTLLLKKKWKSYLVNFSQYFFSFWTQPQRIRLNQLTNSCFDFLGYLSSVPINTLLVRNQMLENSFLIDTRMKKFDTTVLATPLVGSLSKAQFCTGSGHPISKPVWTDLS

SEQ ID NO: 2033 - protein, 176 aa, Zea mays
MELSPNNSTDQSLLDAQLELWHTTFAFMKSMALKSAIHLRIADAIHLHGGAASLSQILSKVHLHPSRVSSLRRLMRVLTTTNVFGTQPLGGGSDDDSEPVYTLTPVSRLLIGSQSSQLAQTPLAAMVLDPTIVSPFSELGAWFQHELPDPCIFKHTHGRGIWELTKDDATFDALVN

SEQ ID NO: 2034 - protein, 201 aa, Solanum lycopersicum
AMPFDLLKKKLMLRLNTLGVRIKEIYEEEWSYIPVGGSLPNTEQKTLAFGAAASMVHPATGYSVVRSLSEAPKCASVLANILRQHYSKNMLTSSSIPSISTQAWNTLWPQERKRQRSFFLFGLALILQLDIEGIRSFFRAFFRVPKWMWQGFLGSSLSSADLMLFAFYMFIIAPNDMRKGLIRHLLSDPTGATLIRTYLTF

SEQ ID NO: 2035 - protein, 101 aa, Solanum lycopersicum
MLGQLVGGLIGGHHDSKKVKGTVVMMKKNALDFTDLAGSLTDKIFEALGQKVSFQLISSVQSDPANGLQGKHSNPAYLENFLLTLTPLAAGETAFGVTFDW

SEQ ID NO: 2036 - protein, 76 aa, Solanum lycopersicum
MALSNTLSLSSSKSLVQSHLLHNPTPQPRFSLFPTTQHGRRHPISAVHAAEPSKTAVKQGKWSLDSWKTKKALQLP

SEQ ID NO: 2037 - protein, 101 aa, Solanum lycopersicum
TQAWNTLWPQERKRQRSFFLFGLALILQLDIEGIRSFFRAFFRVPKWMWQGFLGSSLSSADLMLFAFYMFIIAPNDMRKGLIRHLLSDPTGATLIRTYLTF

SEQ ID NO: 2038 - protein, 76 aa, Zea mays
KGITIWSGNDDECHDSKWKHGATGVISVTSNLVPGLMHSLMYKGENATLNEKLSPLMKWLFCQPNPIALNTALAQL

SEQ ID NO: 2039 - protein, 76 aa, Oryza sativa
VQSELLFRKDRSTFTFDKGWAFPRRIYFNGESCVMPSPDLYPWLPPSSTPRFRTVFLLMSFLVCGTLAFLHNHLVL

SEQ ID NO: 2040 - protein, 76 aa, Zea mays
YTLTPVSRLLIGSQSSQLAQTPLAAMVLDPTIVSPFSELGAWFQHELPDPCIFKHTHGRGIWELTKDDATFDALVN

SEQ ID NO: 2041 - protein, 176 aa, Oryza sativa
MLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWS

SEQ ID NO: 2042 - protein, 176 aa, Zea mays
FLLFLHKQSSCLRLTSSGTFLERIIFSGKMEHFGVMYPGFFRKTIWFFMDPLMHYVRYQGKAILASKGTLLLKKKWKSYLVNFSQYFFSFWTQPQRIRLNQLTNSCFDFLGYLSSVPINTLLVRNQMLENSFLIDTRMKKFDTTVLATPLVGSLSKAQFCTGSGHPISKPVWTDLS

SEQ ID NO: 2043 - protein, 76 aa, Oryza sativa
MASPSSLCLLTALLALVSWQTIASDPSPLQDFCVADEHSPVLVNGFACLDPKHVNADHFFKAAMLDTPRKTNKVGS

SEQ ID NO: 2044 - protein, 126 aa, Solanum lycopersicum
DGTISFLSITAIQHGFKIINMLTTSSIFRHTTSIAAYVRNKLLALKHENGEFVCTLYGLLSSEMGPTVSFNMKRPDGTWYGYREVEKLATLAGIQLRTGCFCNPGACAKYLGLSHLDLLSNIEAGH

SEQ ID NO: 2045 - protein, 201 aa, Oryza sativa
AMVELFVRFEASQYTRPARDNVYLAALPMFHVYGLSLFAVGLLSLGCTVVVMRRFNVDDAVKAIRKYKVTHLPLVPPIMSALLRANPPLELDSLLQVSSGAAPLNHTLIHHFLHAFPHVDFIQGYGMTESTAVGTRGFNTCKHKKYASVGLLAPNMHAKIVHLESGSCLPPGSYGELWLHGPAIMKEFCFVTGYLNDDDDA

SEQ ID NO: 2046 - protein, 151 aa, Solanum lycopersicum
SDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLP

SEQ ID NO: 2047 - protein, 76 aa, Zea mays
MTIAVGRVTKEENDLFPLIDDWLRRDRFVFVGWSGLLLFPCAYFALGGWFTGTTFVTSWYTHGLASSYLEGCNFLT

SEQ ID NO: 2048 - protein, 101 aa, Zea mays
WFHYHKAAPKLAWFQDVESMLNHHLAGLLGLGSLSWAGHQIHVSLPINQFLDAGVDPKEIPLPHEFILNRDLLAQLYPSFAEGATPFFTLNWSKYAEFLSF

SEQ ID NO: 2049 - protein, 251 aa, Oryza sativa
MAIRGPEASSFFPLTLVFSVGFFCARFFLDRLVYKPLAAYCFSSKASKLMNDEVRQAKIVKFSESIWKLTYYGSVQAWVLLIIKQEPWSLDTMQYFEGWPNQYMTSSLMLFYMCQCGFYIYSIFALVAWETRRKDFAVMMSHHVVTSILIGYAYLTGFFRIGTIILALHDASDVFLETAKLCKYTEKELGASLFFGLFALSWLLLRLIYFPFWIIKTSSYQSIISLRKLEKFPTTLYYIFNTMLLTLLVFH

SEQ ID NO: 2050 - protein, 101 aa, Solanum lycopersicum
MTIAIGKFTKDENDLFDIMDDWLRRDRFVFVGWSGLLLFPCAYFAVGGWFTGTTFVTSWYTHGLASSYLEGCNFLTAAVSTPANSLAHSLLLLWGPEAQGD

SEQ ID NO: 2051 - protein, 201 aa, Solanum lycopersicum
GLLEQINITRDVSDYLWYMTDIEIDPTEGFLNSGNWPWLTVFSAGHALHVFVNGQLAGTVYGSLENPKLTFSNGINLRAGVNKISLLSIAVGLPNVGPHFETWNAGVLGPVSLNGLNEGTRDLTWQKWFYKVGLKGEALSLHSLSGSPSVEWVEGSLVAQKQPLSWYKTTFNAPDGNEPLALDMNTMGKGQVWINGQSLGR

SEQ ID NO: 2052 - protein, 76 aa, Oryza sativa
GLGAAVEFNKLNMRYMLDFTCAALFGGEPPSKVVGDGAVTKAMAWLAFQLHPIASKVVKPWPLEELLLHTFSLPPF

SEQ ID NO: 2053 - protein, 151 aa, Oryza sativa
GGPACLTQFKRWATGQSEIIISRNNPILATMFKRLKFRQCLAYLIVLGWPLRAPFELCYGLLGPYCILTNQSFLPKASEDGFSVPLALFISYNTYNFMEYMACGLSARAWWNNHRMQRIISVSAWTLAFLTVLLKSLGLSETVFEVTGKDK

SEQ ID NO: 2054 - protein, 76 aa, Solanum lycopersicum
YPSFAEGATPFFTLNWSKYADFLTFRGGLDPVTGGLWLTDIAHHHLAIAILFLIAGHMYRTNWGIGHGLKDILEAH

SEQ ID NO: 2055 - protein, 101 aa, Oryza sativa
MGKQMAALCGFLLVALLWLTPDVAHAQTQILFQGFNWDSWKKQGGWYNMLKDQVGDIASAGVTHVWLPPPTHSVSPQGYMPGRLYDLNASKYGTKAELKSL

SEQ ID NO: 2056 - protein, 176 aa, Oryza sativa
ITTPSTILTQGFATSGLLTEMHQSTILVPALQSQWLMMHVSMMLLSYATLLCGSLLSAALLMIRFRKNLDFFSKKKKNVLSKTFFFNEIEYFYAKRSALKSTFFPLFPNYYKYQLIERLDSWSYRVISLGFTLLTIGILCGAVWANEAWGSYWNWDPKETWAFITWTIFAIYLHSR

SEQ ID NO: 2057 - protein, 201 aa, Solanum lycopersicum
ADAHDFDSHTSDLEEISRKVFSAHFGQLSIIFLWLSGMYFHGARFSNYEAWLSDPTHIGPSAQVVWPIVGQEILNGDVGGGFRGIQITSGFFQLWRASGITSELQLYCTAIGALVFAALMLFAGWFHYHKAAPKLAWFQDVESMLNHHLAGLLGLGSLSWAGHQVHVSLPINQFLNAGVDPKEIPLPHEFILNRDLLAQLY

SEQ ID NO: 2058 - protein, 76 aa, Oryza sativa
TEKSILNKLQWNLTVPTMYMFILRYLKAALGDEELEHMTFFYAELALVQYSMLFFAPSVIAAAAVYAARCTLGLSP

SEQ ID NO: 2059 - protein, 76 aa, Zea mays
VAQSLGKIRHLVSPRFTFRTMSSYYCSLFLDQVLAYLLMSASSAAASRNDLWVSRFGTDAFVRKITGALWLSFVAF

SEQ ID NO: 2060 - protein, 201 aa, Oryza sativa
VSSCNYESGTHWGLEVGWAYGSMTEDILTGQRIHAAGWRSAKLETEPPAFLGCAPTGGPACLTQFKRWATGLFEILISQNNPLLLSIFKHLQFRQCLAYLTLYVWAVRGFVELCYELLVPYCLLTNQSFLSKASENCFNITLALFLTYNTYNFVEYMECGLSVRAWWNNHRMQRIISASAWLLAFFTVLLKTIGLSETVFE

SEQ ID NO: 2061 - protein, 176 aa, Zea mays
ITTPSTILTQGFATSGLLTEMHQSTILVPALQSQWLMMHVSMMLLSYATLLCGSLLSAALLIIRFRKNFDFFSLKKNVFLKTFFFSEIEYLYAKRSALKNTSFPVFPNYYKYQLTERLDSWSYRVISLGFTLLTVGILCGAVWANEAWGSYWNWDPKETWAFITWTIFAIYLHSRK

SEQ ID NO: 2062 - protein, 76 aa, Oryza sativa
PALTQDFLVQRAVFPATAHYGSDGTLETPRTEPFYAEAALVLFEFEFAAITLVLLAGSLLGRMNIKAWMAFTPLWL

SEQ ID NO: 2063 - protein, 126 aa, Oryza sativa
TEDILTGFKMHCRGWRSVYCMPKRAAFKGSAPINLSDRLNQVLRWALGSVEIFFSRHSPLLYGYKNGNLKWLERFSYINTTIYPFTSLPLLAYCTLPAVCLLTGKFIMPPISTFASLFFIALFISI

SEQ ID NO: 2064 - protein, 201 aa, Zea mays
WFHYHKAAPKLAWFQDVESMLNHHLAGLLGLGSLSWAGHQIHVSLPINQFLDAGVDPKEIPLPHEFILNRDLLAQLYPSFAEGATPFFTLNWSKYAEFLSFRGGLDPITGGLWLSDIAHHHLAIAILFLIAGHMYRTNWGIGHGLKDILEAHKGPFTGQGHKGLYEILTTSWHAQLSLNLAMLGSTTIVVAHHMYSMPPYP

SEQ ID NO: 2065 - protein, 76 aa, Oryza sativa
EGFLVARASVPATAHYGKDGALESPRTEPFYPEASMVLFQFELAAITLVLLAGSLLGRMNIKAWMAFTPLWLLFSY

SEQ ID NO: 2066 - protein, 76 aa, Solanum lycopersicum
MKTLYSLRRFYHVETLFNGTLALAGRDQETTGFAWWAGNARLINLSGKLLGAHVAHAGLIVFWAGAMNLFEVAHFV

SEQ ID NO: 2067 - protein, 76 aa, Zea mays
MKILYSLRRFYHVETLFNGTFVLAGRDQETTGFPWWAGNARLINLSGKLLGAHVAHAGLIVFWAGAMNLFEVAHFV

SEQ ID NO: 2068 - protein, 76 aa, Oryza sativa
MMHMTFYWGKDVTILFDGWRTATWTGYLLSLVALLLASAFYQYLEAFRIRVKLLAGAKPASIPPPASSDAARAPLL

SEQ ID NO: 2069 - protein, 176 aa, Solanum lycopersicum
YPSFAEGATPFFTLNWSKYADFLTFRGGLDPVTGGLWLTDIAHHHLAIAILFLIAGHMYRTNWGIGHGLKDILEAHKGPFTGQGHKGLYEILTTSWHAQLSLNLAMLGSLTIVVAHHMYSMPPYPYLATDYGTQLSLFTHHMWIGGFLIVGAAAHAAIFMVRDYDPTTRYNDLLDR

SEQ ID NO: 2070 - protein, 126 aa, Oryza sativa
MASSSFLLLATLLAMASWQGMASDPSPLQDFCVADMHSPVLVNGFACLNPKDVNADHFFKAAMLDTPRKTNKVGSNVTLINVMQIPGLNTLGISIARIDYAPLGQNPPHTHPRATEILTVLEGTLY

SEQ ID NO: 2071 - protein, 101 aa, Oryza sativa
MAKHSTTMSCLLFFVLLCLGSHLAQAQVLFQGFNWESWKKQGGWYNFLHSHVDDIAATGVTHVWLPPPSHSVAPQGYMPGRLYDLDASKYGTGAELRSLIA

SEQ ID NO: 2072 - protein, 76 aa, Zea mays
MIESQRHSYHLVDPSPWPISGSLGALATTVGGVMYMHSFQGGATLLSLGLIFLLYTMFVWWRDVLRESTLEGHHTK

SEQ ID NO: 2073 - protein, 276 aa, Solanum lycopersicum
TSELQLYCTAIGALVFAALMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYADFLTFRGGLDPVTGGLWLTDIAHHHLAIAILFLIAGHMYRTNWGIGHGLKDILEAHKGPFTGQGHKGLYEILTTSWHAQLSLNLAMLGSLTIVVAHHMYSMPPYPYLATDYGTQLSLFTHHMWIGGFLIVGAAAHAAIFMVRDYDPTTRYNDLLDR

SEQ ID NO: 2074 - protein, 76 aa, Oryza sativa
TVESQLASGGGKSDFTALNDATSFEFIGEAYFGVRPSASSSLGTGGPTKAALWLLWQLAPLTTLGLPMIIEDPLLH

SEQ ID NO: 2075 - protein, 101 aa, Oryza sativa
MGHPHPHPYAPAELHLPGFVPLQLSQAQILVPYLATSLFLLLAVWLISGRCSRRLSDTDRWLMCWWAFTGLTHIIIEGTFVFAPNFFSNQNPSYFDEVWKE

SEQ ID NO: 2076 - protein, 226 aa, Solanum lycopersicum
TVLLGATLALAQKDIKRGLAYSTMSQLGYMMLALGMGSYRSALFHLITHAYSKALLFLGSGSIIHSMETIVGYSPAKSQNMGLMGGLRKHVPITKITFLLGTLSLCGIPPLACFWSKDEILNDSWLYSPIFAIIAWATAGLTAFYMFRIYLLTFEGHLNAHFQNYGGKQKIPFYSISLWGKNGVKKNSCLLTMNNNESTYFLSKTKYPIAKNGRKMTRPFMTIAHF

SEQ ID NO: 2077 - protein, 101 aa, Solanum lycopersicum
LWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALS

SEQ ID NO: 2078 - protein, 101 aa, Zea mays
TLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVAL

SEQ ID NO: 2079 - protein, 201 aa, Solanum lycopersicum
GTAILTLLGGFHPQTQSLWLTDIAHHHLAIAFIFLVAGHMYRTNFGIGHSMKDLLDAHIPPGGRLGRGHKGLYDTINNSLHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEK

SEQ ID NO: 2080 - protein, 276 aa, Zea mays
FGQLSIIFLWLSGMYFHGARFSNYEAWLSDPTHIGPSAQVVWPIVGQEILNGDVGGGFRGIQITSGFFQIWRASGITSELQLYCTAIGALIFASLMLFAGWFHYHKAAPKLAWFQDVESMLNHHLAGLLGLGSLSWAGHQIHVSLPINQFLDAGVDPKEIPLPHEFILNRDLLAQLYPSFAEGATPFFTLNWSKYAEFLSFRGGLDPITGGLWLSDIAHHHLAIAILFLIAGHMYRTNWGIGHGLKDILEAHKGPFTGQGHKGLYEILTTSWHAQL

SEQ ID NO: 2081 - protein, 126 aa, Oryza sativa
WASGFLEILISRNNPILTTTFKSLQFRQCLAYLHSYVWPVRAPFELCYALLGPYCLLSNQSFLPKTSEDGFYIALALFIAYNTYMFMEFIECGQSARACWNNHRMQRITSASAWLLAFLTVILKTL

SEQ ID NO: 2082 - protein, 276 aa, Solanum lycopersicum
YPSFAEGATPFFTLNWSKYADFLTFRGGLDPVTGGLWLTDIAHHHLAIAILFLIAGHMYRTNWGIGHGLKDILEAHKGPFTGQGHKGLYEILTTSWHAQLSLNLAMLGSLTIVVAHHMYSMPPYPYLATDYGTQLSLFTHHMWIGGFLIVGAAAHAAIFMVRDYDPTTRYNDLLDRVLRHRDAIISHLNWACIFLGFHSFGLYIHNDTMSALGRPQDMFSDTAIQLQPVFAQWIQNTHALAPGATAPGATASTSLTWGGGDLVAVGGKVALLPIPL

SEQ ID NO: 2083 - protein, 276 aa, Solanum lycopersicum
FGQLAIIFLWTSGNLFHVAWQGNFESWVQDPLHVRPIAHAIWDPHFGQPAVEAFTRGGALGPVNIAYSGVYQWWYTIGLRTNEDLYTGALFLLFLSAISLIAGWLHLQPKWKPSVSWFKNAESRLNHHLSGLFGVSSLAWTGHLVHVAIPASRGEYVRWNNFLDVLPHPQGLGPLFTGQWNLYAQNPDSSSHLFGTAEGAGTAILTLLGGFHPQTQSLWLTDIAHHHLAIAFIFLVAGHMYRTNFGIGHSMKDLLDAHIPPGGRLGRGHKGLYDTI

SEQ ID NO: 2084 - protein, 226 aa, Zea mays
TLFLGATLALAQRDIKRSLAYSTMSQLGYMMLALGIGSYQAALFHLITHAYSKALLFLGSGSVIHSMEPLVGYSPDKSQNMVLMGGLRKYVPITRTTFLCGTLSLCGIPPLACFWSKDEILSNSWLYSPFFGIIASFTAGLTAFYMFRIYLLTFDGYLRVHFQNYSSTKEGSLYSISLWGKSISKGVNRDFVLSTMKSGVSFFSQNIPKIPANTRNKIGSFSTPFG

SEQ ID NO: 2085 - protein, 76 aa, Oryza sativa
SVVFVAPPPGMPVSQIWTQKSSLAGEHAAAGNFDTAMRLLSRQLGIKNFAPLKPLFLDLHMGSHSYLRALATAPII

SEQ ID NO: 2086 - protein, 76 aa, Oryza sativa
SAVFVAPPPGMPVSLIWTQKSSLAGEHAAAGNFDTAMRLLSRQLGIKNFAPLKPLFVDLHMGSHSYLRALATAPII

SEQ ID NO: 2087 - protein, 251 aa, Solanum lycopersicum
IAGWLHLQPKWKPSVSWFKNAESRLNHHLSGLFGVSSLAWTGHLVHVAIPASRGEYVRWNNFLDVLPHPQGLGPLFTGQWNLYAQNPDSSSHLFGTAEGAGTAILTLLGGFHPQTQSLWLTDIAHHHLAIAFIFLVAGHMYRTNFGIGHSMKDLLDAHIPPGGRLGRGHKGLYDTINNSLHFQLGLALASLGVITSLVAQHMYSLPAYAFIAQDFTTQAALYTHHQYIAGFIMTGAFAHGAIFFIRDYNPE

SEQ ID NO: 2088 - protein, 176 aa, Oryza sativa
MASPTRPGPYMPRPPAVPEWLNTGDNGWQLAAATFVGLQSMPGLVVLYGSIVKKKWAVNSAFMALYAYASTLIVWVLVGFRMAFGDRLLPFWGKAGAALTEGFLVARASVPATAHYGKDGALESPRTEPFYPEASMVLFQFELAAITLVLLAGSLLGRMNIKAWMAFTPLWLLFSY

SEQ ID NO: 2089 - protein, 101 aa, Oryza sativa
AMKSMRYTHMTFFWGKNSEVLFTMWPGTRGGMYALALIFVFALAVIVEFLGSRRADACLAALARRAPAAGGLARAAVHTVRVGVAYLLMLALMSFNGGVFL

SEQ ID NO: 2090 - protein, 76 aa, Zea mays
LPSQHLDPALPKLFWFTPTLPTCPTVAKQFWDTKRTSPDGNLKVANLPSFAISFATAPAALANCPPLPRVISMLCM

SEQ ID NO: 2091 - protein, 251 aa, Oryza sativa
MHLRMASPPQPGPYMPDLPAVPAWLNKGDTAWQLVAATFVGIQSMPGLVVIYGSIVKKKWAVNSAFMALYAYASTLIVWVLVGFRMAFGDRLLPFWAKAGPALTQDFLVQRAVFPATAHYGSDGTLETPRTEPFYAEAALVLFEFEFAAITLVLLAGSLLGRMNIKAWMAFTPLWLLFSYTVGAFSLWGGGFLYQWGVIDYSGGYVIHLSSGVAGFTAAYWVGPRLKSDRERFSPNNILLMIAGGGLLWLG

SEQ ID NO: 2092 - protein, 76 aa, Oryza sativa
MAKRIASMSSLLLIALLCLSSHLAQAQVLFQGFNWESWKKQGGWYNFLHGHVDDIAATGVTHVWLPPPSHSVAPQG

SEQ ID NO: 2093 - protein, 76 aa, Zea mays
GTLSLCGIPPLACFWSKDEILSNSWLYSPFFGIIASFTAGLTAFYMFRIYLLTFDGYLRVHFQNYSSTKEGSLYSI

SEQ ID NO: 2094 - protein, 151 aa, Solanum lycopersicum
IAGWLHLQPKWKPSVSWFKNAESRLNHHLSGLFGVSSLAWTGHLVHVAIPASRGEYVRWNNFLDVLPHPQGLGPLFTGQWNLYAQNPDSSSHLFGTAEGAGTAILTLLGGFHPQTQSLWLTDIAHHHLAIAFIFLVAGHMYRTNFGIGHSM

SEQ ID NO: 2095 - protein, 176 aa, Zea mays
MTIAVGRVTKEENDLFPLIDDWLRRDRFVFVGWSGLLLFPCAYFALGGWFTGTTFVTSWYTHGLASSYLEGCNFLTAAVSTPANSLAHSLLLLWGPEAQGDFTRWSQLGGLWTFLALHGAFALIGFMLRQFELARPVQLRPYNAISFSGPIAVFLSVFLIYPLGQSGWFFSPSFGV

SEQ ID NO: 2096 - protein, 251 aa, Zea mays
IGGWLHLQPKWKPSLSWFKNAESRLNHHLSGLFGVSSLAWTGHLVHVAIPGSSRGEYVRWNNFLDVLPYPQGLGPLLTGQWNLYAQNPDSSNHLFGTTQGAGTAILTLLGGFHPQTQSLWLTDIAHHHLAIAFIFLIAGHMYRTNFGIGHSIKDLLEAHTPPGGRLGRGHKGLYDTINNSIHFQLGLALASLGVITSLVAQHMYSLPAYAFIAQDFTTQAALYTHHQYIAGFIMTGAFAHGAIFFIRDYNP

SEQ ID NO: 2097 - protein, 76 aa, Oryza sativa
MKNTSSLCLLLLVVLCSLTCNSGQAQVLFQGFNWESWKQQGGWYNMLKGQVDDIAKAGVTHVWLPPPSHSVAPQGY

SEQ ID NO: 2098 - protein, 251 aa, Oryza sativa
LEIFFSRNNALLAGGRRRLHPLQRAAYLNTTVYPFTSLFLMAYCLFPAIPLIAGGGGWNAAPTPTYVAFLAALMVTLAAVAVLETRWSGIALGEWWRNEQFWMVSATSAYLAAVAQVALKVATGKEISFKLTSKHLASSATPVAGKDRQYAELYAVRWTALMAPTAAALAVNVASMAAAGGGGRWWWWDAPSAAAAAAAALPVAFNVWVVVHLYPFALGLMGRRSKAVRPILFLFAVVAYLAVRFLCLLLQ

SEQ ID NO: 2099 - protein, 251 aa, Zea mays
FGQLAIIFLWTSGNLFHVAWQGNFESWIQDPLHVRPIAHAIWDPHFGQPAVEAFTRGGAAGPVNIAYSGVYQWWYTIGLRTNEDLYTGALFLLFLSTLSLIGGWLHLQPKWKPSLSWFKNAESRLNHHLSGLFGVSSLAWTGHLVHVAIPGSSRGEYVRWNNFLDVLPYPQGLGPLLTGQWNLYAQNPDSSNHLFGTTQGAGTAILTLLGGFHPQTQSLWLTDIAHHHLAIAFIFLIAGHMYRTNFGIGHS

SEQ ID NO: 2100 - protein, 151 aa, Zea mays
IGGWLHLQPKWKPSLSWFKNAESRLNHHLSGLFGVSSLAWTGHLVHVAIPGSSRGEYVRWNNFLDVLPYPQGLGPLLTGQWNLYAQNPDSSNHLFGTTQGAGTAILTLLGGFHPQTQSLWLTDIAHHHLAIAFIFLIAGHMYRTNFGIGHS

SEQ ID NO: 2101 - protein, 176 aa, Oryza sativa
PALTQDFLVQRAVFPATAHYGSDGTLETPRTEPFYAEAALVLFEFEFAAITLVLLAGSLLGRMNIKAWMAFTPLWLLFSYTVGAFSLWGGGFLYQWGVIDYSGGYVIHLSSGVAGFTAAYWVGPRLKSDRERFSPNNILLMIAGGGLLWLGWAGFNGGAPYAPNVTATVAVLNTNV

SEQ ID NO: 2102 - protein, 101 aa, Oryza sativa
CWVTWGYNMSFGHKLLPFWGKARPALGQSFLLAQAVLPQTTQFYKGGGGADAVVETPWVNPLYPMATMVYFQCVFAAITLILLAGSLLGRMNIKAWMLFVP

SEQ ID NO: 2103 - protein, 176 aa, Oryza sativa
RAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMIT

SEQ ID NO: 2104 - protein, 126 aa, Solanum lycopersicum
MSTLFFTFSLLLLAPLLVISSIQDPELVVQDVHRSINASLTRRNLGYLSCGSGNPIDRLLAMQPQLGKKSPAFSYCAIGFGKNAIGGKNGRIYVVTDSGNDDPVNPKPGTLRHAVIQDEPLWIIFK

SEQ ID NO: 2105 - protein, 276 aa, Zea mays
ELRPSELWASEKGYKAMTSNFRRYSYRELVKATRKFKVELGRGESGTVYKGVLEDDRHVAVKKLENVRQGKEVFQAELSVIGRINHMNLVRIWGFCSEGSHRLLVSEYVENGSLANILFSEGGNILLDWEGRFNIALGVAKGLAYLHHECLEWVIHCDVKPENILLDQAFEPKITDFGLVKLLNRGGSTQNVSHVRGTLGYIAPEWVSSLPITAKVDVYSYGVVLLELLTGTRVSELVGGTDEVHSMLRKLVRMLSAKLEGEEQSWIDGYLDSKLN

SEQ ID NO: 2106 - protein, 251 aa, Zea mays
ATGGFSEDSQVGKGSFSCVFKGILRDGTVVAVKRAIKASDVKKSSKEFHNELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDIFAILDPVLSPPSDLEALK

SEQ ID NO: 2107 - protein, 126 aa, Zea mays
ACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDIFAILDPVLSPPSDLEALK

SEQ ID NO: 2108 - protein, 101 aa, Oryza sativa
MAKRHLLLVTTCLWALSCALLLHASSDGFLRVNLNKKRLDKEDLTAAKLAQQGNRLLKTGSSDSDPVPLVDYLNTQYYGVIGLGSPPQNFTVIFDTGSSNL

SEQ ID NO: 2109 - protein, 176 aa, Oryza sativa
SLRAGDQIRREIATLKLLRHPHVVRLHEVAASKTKIYMVLEFVNGGELFERIAVKGKLSEKEGRRLFQQLIDGVSYCHDRGVYHRDLKPENVLVDQKGNIKISDFGLSALPQHLGNDGLLHTTCGSPNYIAPEVLQNKGYDGSLSDIWSCGVILYVMLIGYLPFDDRNIVVLYQKI

SEQ ID NO: 2110 - protein, 251 aa, Oryza sativa
MVNGEAEAECTRASLLGRYEIGRTLGEGNFGKVKYARHLATGAHFAIKILDRNKILSLRFDDQIRREIGTLKLLKHPNVVRLHEVAASKTKIYMVLEYVNGGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLVVLYQKIFKGDTQIPKWLSPSARDLL

SEQ ID NO: 2111 - protein, 126 aa, Oryza sativa
GGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLV

SEQ ID NO: 2112 - protein, 176 aa, Oryza sativa
CANCRDGFENYCAGLVPSFNAALPDGATVHGGFSELAVVNQRYVVRIPGGGGGASPAPLDRLAPLLCAGVTVYCPMRRLGLDRPGVHLGVAGLGGLGHLAVKFGKAFGVKVTVISTSPWKEAEAVERLGADAFLLSTNAEQMKAAAGTMDGIIDTVSAVHDLTPLITLLRTHGQLV

SEQ ID NO: 2113 - protein, 151 aa, Oryza sativa
HVIRLHEVMATRSRIYFVMEYASGGELFTRLSRSPRFPEPVARRYFQQLITAVEFCHSRGVYHRDLKPENLLLDARGDLKVTDFGLSALDGGLRGDGLLHTTCGTPAYVAPEVLLKRGYDGAKADIWSCGVILFVLLAGYLPFNETNLVIL

SEQ ID NO: 2114 - protein, 201 aa, Oryza sativa
ELGRMLGRGTFAKVYLARAVAGGEAVAVKVIDKAEVMGTAGMAPRVLREVAAMRRLRHPHVLRLHEVLATRARIYLVMELATGGDLLSRLAALPRRRLPESAARRVFVQLVDALSYCHARGVAHRDVKPQNVLLDGDGNLKVSDFGLAALPDTLRDDGRLHTACGTPAYAAPEVLRRRAYDGAKADAWSCGVILFVLLAGH

SEQ ID NO: 2115 - protein, 101 aa, Oryza sativa
CHEKGVYHRDLKPENVLVDAKGNIKVSDFGLSALPQNQRKDGLLHTTCGSPNYIAPEVLLNRGYDGSLSDIWSCGVILYVMLTGNLPFDDQNTVVLYQKIL

SEQ ID NO: 2116 - protein, 276 aa, Solanum lycopersicum
CSSLELVDISYNNFSGKLPVDTLSKLSNIKTMVLSFNKFVGGLPDSFSNLLKLETLDMSSNNLTGVIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLL

SEQ ID NO: 2117 - protein, 176 aa, Solanum lycopersicum
SQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLL

SEQ ID NO: 2118 - protein, 276 aa, Solanum lycopersicum
SQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGT

SEQ ID NO: 2119 - protein, 101 aa, Oryza sativa
YCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKI

SEQ ID NO: 2120 - protein, 101 aa, Oryza sativa; identical to SEQ ID NO: 2119

SEQ ID NO: 2121 - protein, 226 aa, Oryza sativa
MAATKSKAAKKGAPLLGKYELGRLLGRGTFAKVYHARSLAPGADPVAVKVLDKPDLAAAGAGMATRVLREVAAMRRLRHPNVLRLHEVLATRSKVYLVMELAPGGDLLSRLASLPSRRLPEHAAQRVFLQLVSALIYCHARGVSHRDVKPQNVLLDAHGNLKVSDFGLAALPDSLRDDGRLHTACGTPAFAAPEVLRRKAYDGAKADAWSCGVILFVLLAGHLPFD

SEQ ID NO: 2122 - protein, 201 aa, Zea mays
VVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEFLLNDEFYIGLRQKRATGEEYDELIEEFMSAVKQFYGEKVLIQFEDFANHNAFDLLEKYSKSHLVFNDDIQGTASVVLAGLLAALKMVGGTLAE

SEQ ID NO: 2123 - protein, 251 aa, Zea mays
SYLLETLNDRYSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIYWAPASIQVALSRKSPYVQTTHRVSGLMLANHTSIRHLFSKCLGQYEKLR

SEQ ID NO: 2124 - protein, 176 aa, Oryza sativa
KDTILNHRMLHQIKREISIMKIVRHPNIVRLNEVLAGKTKIYIILELITGGELFDKIARQGKLRENEARKYFQQLIDAINYCHSKGVYHRDLKPENLLLDSRGNLKVSDFGLSTLAQKGVGLLHTTCGTPNYVAPEVLSNNGYDGSAADVWSCGVILYVLMAGYLPFEEDDLPTLY

SEQ ID NO: 2125 - protein, 201 aa, Zea mays
MATPAVKVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAHQLSPPAIAIVVECVFAPFLGRERNQAVVDENVEKLKKVLEVYEARLATCTYLAGDFLSLADLSPFTIMHCLMATEYAALVHALPHVSAWWQGLAA

SEQ ID NO: 2126 - protein, 176 aa, Oryza sativa
VKVVAKEKVVRAGMMEQIKREIAVMKRVSHPNIVELHEVMATRSKIYLALELVRGGELFGRIVRLGRVREDAARHYFRQLVSAVDFCHSRGVYHRDLKPENLLLDEAGNLKVVDFGLSALADHARADGLLHTLCGTPGYAAPEVLRDKGYDGAKADLWSCGVILYVLLAGSLPFPD

SEQ ID NO: 2127 - protein, 201 aa, Zea mays
YTRRRYDRTSVGLIPNNRLDRNNTNSFYSKAKIQSLSQHQEVIGTLLNRNKEYPSLMILLASNCSRIGLFKNSKYPNAVKESNPRIPIRDIFGLLGVIVPSISNFSSSYYLLTHNQILLKKYLFLDNLKQTLQVLQGLKYSLIDENKRISNFDSNIMLEPFHLNWHFLHHDSWEETLAIIHLGQFICENLCLFKLHIKKSG

SEQ ID NO: 2128 - protein, 226 aa, Zea mays
VRPAVAYEMDEGINLATLFPQDLLQEEDNLQLRLVNFISHENSKLTQRIYHTNSQFVRTCLVVNWEQEEKEGARASLVEVKTNDLIRDFLRIELVKSTILYTRRRYDRTSVGLIPNNRLDRNNTNSFYSKAKIQSLSQHQEVIGTLLNRNKEYPSLMILLASNCSRIGLFKNSKYPNAVKESNPRIPIRDIFGLLGVIVPSISNFSSSYYLLTHNQILLKKYLFLD

SEQ ID NO: 2129 - protein, 76 aa, Zea mays
MGTRPRGVVLAPWAVVLVLVLALRLAGASHVIHRSLEAEAAPSVPASIVSPLLRTGYHFQPPMNWINDPNAPLYYK

SEQ ID NO: 2130 - protein, 176 aa, Zea mays
MKNVTHSFVFLAHWPFAGSFGLNTDILATNLINLTVVVGVLIFFGKGVLKDLLDNRKQRILSTIRNSEELRKGTLEQLEKARIRLQKVELEADEYRMNGYSEIEREKENLINATSISLEQLEKSKNETLYFEKQRAMNQVRQQGFQQAVQGALGTLNSCLNTELHFRTIRANIGIL

SEQ ID NO: 2131 - protein, 126 aa, Zea mays
CQEVLEELDVYKRLKLTLELVKKEMEISKLQQSIAKAIEEKISGDQRRYLLNEQLKAIKKELGLETDDKTALSAKFRERIESKKDKCPPHVLQVIEEELTKLQLLEASSSEFSVTRNYLDWLTVLP

SEQ ID NO: 2132 - protein, 76 aa, Solanum lycopersicum
LLYSDVENDEHLCVLKDRTKPILFTMARLDRVKNLTGLVEWYAKNPRLRGLVNLVVVGGDRRKESKDLEEQAEMKK

SEQ ID NO: 2133 - protein, 76 aa, Solanum lycopersicum
EQLADLDLRIIIENSLVEWEELGEEGHTGNEWEDRKVGRRKDFLVRRVELAKHFIRTNIEPEWMVLCLLPVLPPEL

SEQ ID NO: 2134 - protein, 76 aa, Zea mays
EQLADLDLRIIIENSLVEWKELEDEGYSGDEWEDRKRRIRKVFLIRRMQLAKHFIQTNVEPEWMVLCLLPVLPPEL

SEQ ID NO: 2135 - protein, 176 aa, Zea mays
EQLADLDLRIIIENSLVEWKELEDEGYSGDEWEDRKRRIRKVFLIRRMQLAKHFIQTNVEPEWMVLCLLPVLPPELRPIVYRSGDKVVTSDINELYKRVIRRNNNLAYLLKRSELAPADLVMCQEKLVQEAVDTLLDSGSRGQPTRDGHNKVYKSLSDVIEGKEGRFRETLLGKRV

SEQ ID NO: 2136 - protein, 101 aa, Solanum lycopersicum
MAERVLTRVHRLRERVDATLCAHRNEILLFLSRIESHGKGILKPHELLAEFDAIRQDDKDKLNEHAFEELLKSTQEAIVLPPWVALAIRLRPGVWEYVRVN

SEQ ID NO: 2137 - protein, 76 aa, Zea mays
NGIYITLVKDVRDAFEGSDLVKIDCEGLNPSDYKKIGAKLRDLVPCVLLSFDDEQILMHRGKEWKSRYSKPLTLIP

SEQ ID NO: 2138 - protein, 101 aa, Oryza sativa
LIQRIIREKRARRAAASPPRDAIDVLIGDGSDELTDELISDNMIDLMIPAEDSVPVLITLAVKFLSECPLALHQLEEENIQLKRRKTDMGETLQWTDYMSL

SEQ ID NO: 2139 - protein, 151 aa, Oryza sativa
DFYVLQEGDEVLVIAEDDDTYAPAPLPKVMRGYLPKDFVVPKSPERILFCGWRRDMEDMIMVLDAFLAPGSELWMFNDVPEMDRERKLIDGGLDFSRLENITLVHREGNAVIRRHLESLPLESFDSILILADESVEDSAIQADSRSLATLL

SEQ ID NO: 2140 - protein, 76 aa, Zea mays
MDRLDGSARLLLVSDLDQTMIDHDDRENLSLLRFEALWEAEFAQDSLLVFSTGRTPVSYKGLRRDKPLVTPDVTIM

SEQ ID NO: 2141 - protein, 76 aa, Oryza sativa
ALEGKFKELRDEQCSYDNTLICLNKMWNQLIDDLVLLGVRAGGDLNGLQALDHEEMSEESLESCPSEEIFLFRLLN

SEQ ID NO: 2142 - protein, 276 aa, Solanum lycopersicum
FDFIEKHNLHDAVREKVLQLMMIDCKRAVLLLIQQRDLIPPSEVVSQLIAARDKCDYRYFLHLYLHSLFEVNLHAGKDYHDMQVELYADYDPKMLLTFLRSSQHYTLEKAYEICVKKDLLKEQVFILGRMGNAKQALAVIINRLGDIEEAIEFVSMQQDDELWEELIQQSFHKPEMVGVLLEHTVGNLDPLYIVNMLPNDLEIPRLRDRLVKIVTDYRTETSLRHGCNDILKADCVNLLVKYYKEAKRGVCLSDEVDDVSSRRGEKSVSHLGERTM

SEQ ID NO: 2143 - protein, 276 aa, Zea mays
CQEVLEELDVYKRLKLTLELVKKEMEISKLQQSIAKAIEEKISGDQRRYLLNEQLKAIKKELGLETDDKTALSAKFRERIESKKDKCPPHVLQVIEEELTKLQLLEASSSEFSVTRNYLDWLTVLPWGNYSDENFDVHHAQKILDEDHYGLSDVKERILEFIAVGKLRGTSQGKIICLSGPPGVGKTSIGRSIARALNRQFYRFSVGGLADVAEIKGHRRTYVGAMPGKMVQCLKSVGTANPLVLIDEIDKLGKGHSGDPASALLELLDPEQNVNF

SEQ ID NO: 2144 - protein, 276 aa, Zea mays
EQLADLDLRIIIENSLVEWKELEDEGYSGDEWEDRKRRIRKVFLIRRMQLAKHFIQTNVEPEWMVLCLLPVLPPELRPIVYRSGDKVVTSDINELYKRVIRRNNNLAYLLKRSELAPADLVMCQEKLVQEAVDTLLDSGSRGQPTRDGHNKVYKSLSDVIEGKEGRFRETLLGKRVDYSGRSVIVVGPSLSLHQCGLPLEIAIKLFQLFVIRDLITKRATSNVRIAKRKIWEKEPIVWEILQEVMRGHPVLLNRAPTLHRLGIQAFQPTLVEGRTI

SEQ ID NO: 2145 - protein, 226 aa, Zea mays
RGHMTERAELLKEEVRKTLKAAANQITNALDLIITLQRLGLDHHYENEISELLRFVYSSSDYDDKDLYVVSLRFYLLRKHGHCVSSDVFTSFKDEEGNFVVDDTKCLLSLYNAAYVRTHGEKVLDEAITFTRRQLEASLLDPLEPALADEVHLTLQTPLFRRLRILEAINYIPIYGKEAGRNEAILELAKLNFNLAQLIYCEELKEVTLWWKQLNVETNLSFIRDR

SEQ ID NO: 2146 - protein, 176 aa, Solanum lycopersicum
FDFIEKHNLHDAVREKVLQLMMIDCKRAVLLLIQQRDLIPPSEVVSQLIAARDKCDYRYFLHLYLHSLFEVNLHAGKDYHDMQVELYADYDPKMLLTFLRSSQHYTLEKAYEICVKKDLLKEQVFILGRMGNAKQALAVIINRLGDIEEAIEFVSMQQDDELWEELIQQSFHKPEM

SEQ ID NO: 2147 - protein, 226 aa, Zea mays
RGHMTERAELLKEEVRKTLKAAANQIKNALDLIITLQRLGLDHHYENEISELLRFVYSSSDYDDKDLYVVSLRFYLLRKHGHCVSSDVFTSFKDEEGNFVVDDTKCLLSLYNAAYFRTHGEKVLDEAIAFTRRQLEASLLDPLEPALADEVHLTLQTPLFRRLRILEAINYIPIYGKEAGRNEAILELAKLNFNLAQLIYCGELKEVTLWWKQLNVETNLSFIRDR

SEQ ID NO: 2148 - protein, 226 aa, Zea mays
RGHMTERAELLKEEVRKTLKAAANQIKNALDLIITLQRLGLDHHYENEISELLRFVYSSSDYDDKDLYVVSLRFYLLRKHGHCVSSDVFTSFKDEEGNFVVDDTKCLLTLYNAAYLRTHGEKVLDEAITFTRRQLEASLLDPLEPALLADEVSLTLQTPLFRRLRILEAINYIPIYGKEAGRNEAILELAKLNFNLAQLIYCEELKEVTLWWKQLNVETNLSFIRD

SEQ ID NO: 2149 - protein, 101 aa, Zea mays
GTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWD

SEQ ID NO: 2150 - protein, 126 aa, Oryza sativa
ENRVKVFHKRSDELKVRDDLDSPADILVSEILDSELLGEGLIPTLQQAYDMLLAKNPKIVPYRATTYGQLVESTFLWKLHDLHNNEANAADGVWLTPGEMERIVSVKPQQHAMQCDALEDEIRLLS

SEQ ID NO: 2151 - protein, 76 aa, Zea mays
LIRSKFLEPLEEWMAKNRFGRFSSLVETAIDLAQLENGEYRISPLYSSDLGVLKDELSVVENHINNLHVDTASDLD

SEQ ID NO: 2152 - protein, 151 aa, Solanum lycopersicum
RGILVIGSIGTGRSYLVKYLATNSYVPFITVFLNKFLDNKSKGFLLDEIDIDDSDDIDDSDNLDASDDIDRDLDTELELLTRMNGLTVDMMPEIDRFYITLQFELAKAMSPCIIWIPNIHDLDVNESNDLSLGLLVNHLSRDCERCSTRNI

SEQ ID NO: 2153 - protein, 126 aa, Zea mays
ENYELGLPCIEKAGVAHKIDFREGPALPVLDDLIAEEKNHGSFDFVFVDADKDNYLNYHERLLKLVKLGGLIGYDNTLWNGSVVLPDDAPMRKYIRFYRDFVLVLNKALAADDRVEICQLPVGDGV

SEQ ID NO: 2154 - protein, 176 aa, Zea mays
MASWDNLGELSNIAQLTGLDAVKLISLIVRAASTARLHKRNCRRFAQHLKLIGGLLEQLRVSELRKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCTNPTIVLK

SEQ ID NO: 2155 - protein, 126 aa, Solanum lycopersicum
MAALIPENLSREQCLYLAKLAEQAERYEEMVQFMDKLVLNSTPAGELTVEERNLLSVAYKNVIGSLRAAWRIVSSIEQKEESRKNEEHVHLVKEYRGKVENELSQVCAGILKLLESNLVPSATTSE

SEQ ID NO: 2156 - protein, 76 aa, Oryza sativa
LDITRFSSYHELRRELGRLFGLEGQLENPLRSGWQLVFVDREDDVLLVGDDPWQEFVNSVSCIKILSPQEVQQMGK

SEQ ID NO: 2157 - protein, 226 aa, Zea mays
AKHYIEFWKKVPPNEPYRVILSDVRDKLYNTRERSRELLSSGHSDIPEEATLTNVEQLLEPLELCYRSLCACGDSVIADGTLLDFLRQVSTFGLSLVRLDIRQESDRHTDVLDAITTYLGIGSYREWTEERRQEWLLSELNGKRPLFGSDLPKTEEISDVLDTFHVIAELPSDNFGAYIISMATAPSDVLAVELLQRECHVKTPLRVVPLFEKLADLEAAPAALAR

SEQ ID NO: 2158 - protein, 151 aa, Solanum lycopersicum
GVEVEVTDMDWESTFFLRHLPSSNISQLPDLDDVYREVMRDFRKRLEKLAEELLDLLCENLGLEKSYLKNTFYGSKGPNFGTKVSNYPPCPKPDLIKGLRAHTDAGGIILLFQDDKVSGLQLLKDGRWIDVPPMRHSIVVNLGDQLEVITN

SEQ ID NO: 2159 - protein, 151 aa, Zea mays
RRNNNLAYLLKRSELAPADLVMCQEKLVQEAVDTLLDSGSRGQPTRDGHNKVYKSLSDVIEGKEGRFRETLLGKRVDYSGRSVIVVGPSLSLHQCGLPLEIAIKLFQLFVIRDLITKRATSNVRIAKRKIWEKEPIVWEILQEVMRGHPVL

SEQ ID NO: 2160 - protein, 76 aa, Zea mays
ELTLALEKLVNEKLHSLHGVATRCNDPQLIDFIESEFLEEQGEAINKVSKYVAQLRRVGNKGHGVWHFDQMLLQEA

SEQ ID NO: 2161 - protein, 101 aa, Oryza sativa
LIDKEFNVMGYTLLLSLIEYKTLVMRGDIERANDILPSIPKAQYNNVAHFLESRGMLEEALEIATDADYRFDLAVQLGKLEVAKAIAMEAQSESKWKQLGE

SEQ ID NO: 2162 - protein, 101 aa, Zea mays
VRPAVAYEMDEGINLATLFPQDLLQEEDNLQLRLVNFISHENSKLTQRIYHTNSQFVRTCLVVNWEQEEKEGARASLVEVKTNDLIRDFLRIELVKSTILY

SEQ ID NO: 2163 - protein, 101 aa, Zea mays
EWTEERRQEWLLSELNGKRPLFGSDLPKTEEISDVLDTFHVIAELPSDNFGAYIISMATAPSDVLAVELLQRECHVKTPLRVVPLFEKLADLEAAPAALAR

SEQ ID NO: 2164 - protein, 126 aa, Zea mays
VFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQ

SEQ ID NO: 2165 - protein, 151 aa, Solanum lycopersicum
AVQAEVTDLDWESTFFLRHLPTSNISQVPDLDEEYREVMRDFAKRLEKLAEELLDLLCENLGLEKGYLKNAFYGSKGPNFGTKVSNYPPCPKPDLIKGLRAHTDAGGIILLFQDDKVSGLQLLKDEQWIDVPPMRHSIVVNLGDQLEVITN

SEQ ID NO: 2166 - protein, 151 aa, Solanum lycopersicum; identical to SEQ ID NO: 2165

SEQ ID NO: 2167 - protein, 101 aa, Zea mays
AAVRALNIAEGKTDVNKNFSLFGLMNRTCTVGMGKRLLNRWLKQPLLDVNEINNRLDMVQAFVEDPELRQGLRQQLKRISDIDRLTHSLRKKSANLQPVVK

SEQ ID NO: 2168 - protein, 201 aa, Zea mays
GSKVTKYYIEFWKQIPPNEPYRVILGHVRDKLYNTRERARHLLASGVSEISAESSFTSIEEFLEPLELCYKSLCDCGDKAIADGSLLDLLRQVFTFGLSLVKLDIRQESERHTDVIDAITTHLGIGSYREWPEDKRQEWLLSELRGKRPLLPPDLPQTDEIADVIGAFHVLAELPPDSFGPYIISMATAPSDVLAVELLQR

SEQ ID NO: 2169 - protein, 176 aa, Zea mays
YDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCY

SEQ ID NO: 2170 - protein, 76 aa, Oryza sativa
HELRSEVGRLFGLEGQLEDPLRSGWQLVFVDREDDVLLVGDDPWQEFVNSVSCIKILSPQEVQQMGKPGIELFSTS

SEQ ID NO: 2171 - protein, 226 aa, Zea mays
HSEVGHKSLLKSDDLYQYILDTSVYPREPESMKELREVTAKHPWNLMTTSADEGQFLNMLIKLIGAKKTMEIGVYTGYSLLATALALPEDGTILAMDINRENYELGLPCIEKAGVAHKIDFREGPALPVLDDLIAEEKNHGSFDFVFVDADKDNYLNYHERLLKLVKLGGLIGYDNTLWNGSVVLPDDAPMRKYIRFYRDFVLVLNKALAADDRVEICQLPVGDGV

SEQ ID NO: 2172 - protein, 101 aa, Solanum lycopersicum
QWHVHELELVEVVADQVAVALSHAAILEESMRARDLLMEQNVALDLARREAEMAVRARNDFLAVMNHEMRTPMHAIIALSSLLQETDLTPEQRLMVETILK

SEQ ID NO: 2173 - protein, 176 aa, Solanum lycopersicum
AALKVLVEKMGVPDSKARCKIRDAQIVSSYLIDRNTVKLGCCDWWMKRSKRVATLEFDRVRKSMGVIVREPNGSNRLLVKGAFESLLERSTYVQLADGSTVPLDESCRQLLLLKQLEMSSKGLRCLGLAYKDDLGELSGYYAATHPAHKKLLDPSCYSSIESDLVFVGVVGLRDPP

SEQ ID NO: 2174 - protein, 176 aa, Solanum lycopersicum
PRTGSDLRNQSRSGKKSQYRIRLEEKQKLRFHYGLTERQLLKYVRIARKAKGSTGQVLLQLLEMRLDNILFRLGMASTIPAARQLVNHRHILVNGHIVDIPSYRCKPRDIITAKDEQKSRALIQISLDSSPHEELPNHLTLQPFQYKGLVNQIIDSKWVGLKINELLVVEYYSRQT

SEQ ID NO: 2175 - protein, 176 aa, Oryza sativa
LTVKDELFKDESFRRLSSAVAYDGKRNLFTCAELPDGLFRVKVRSRTYIVSVEFKKKLPLSQLSELPVPREVLQGLDVIVREASSWRKIIIGQGFYSQGRSVPIGPDVVALKGTQQTLKCTQKGLILCVDYSVMPFRKAGPVLDLVQKSVRYLDYRTTLNKHQLDTLKNELKGQRV

SEQ ID NO: 2176 - protein, 176 aa, Oryza sativa
TLQDHLKDAVNGLNHESLNVRYMVACELNKLFNDRRGDITSLIIGEDIADLDIISSLIMSLLKGCAEESRTVVGQRLKLVCADCLGALGAVDPAKFKVMSCERFKIECSDDDLIFELIHKHLARAFRAASDTTVQDSAALAIQELLKLSGCQSLPNESSSCKMSKRGQKLWGRFSS

SEQ ID NO: 2177 - protein, 76 aa, Oryza sativa
SRLLSVQPYKRPTASDLLRHPWVIGDCAKQDLMDAEVVSKLQKFNARRKLRAAAIASVLSCKVALRTKRLRNLLGT

SEQ ID NO: 2178 - protein, 151 aa, Zea mays
VASWGVDYVVLTSVDRDDLPDGGSSHFAQTVKALKELKPGILVECLTSDFRGDLEAISSLANSGLDVYAHNIETVRSLQRVVRDPRAGYDQSLAVLKHAKGSREDMITKSSIMLGLGETDEEVKQAMMDLRAIGVDILTLGQYLQPSERHL

SEQ ID NO: 2179 - protein, 126 aa, Zea mays
VKLDIRQESERHTDVIDAITTHLGIGSYREWPEDKRQEWLLSELRGKRPLLPPDLPQTDEIADVIGAFHVLAELPPDSFGPYIISMATAPSDVLAVELLQRECGVRQPLPVVPLFERLADLQSAPA

SEQ ID NO: 2180 - protein, 126 aa, Oryza sativa
LIDKQFNVVGYTLLLTMIEYKTLVMRGDFDRANALLPSIPKEQHDSVARFLESRGMLEEALEIATDSNYRFDLAVQLGRLEVAKAIAIEAQSESKWRQLGELAMSTGKLDMAEECLLHAMDLSGLL

SEQ ID NO: 2181 - protein, 76 aa, Zea mays
MASWDNLGELSNIAQLTGLDAVKLISLIVRAASTARLHKRNCRRFAQHLKLIGGLLEQLRVSELRKYPETREPLEQ

SEQ ID NO: 2182 - protein, 201 aa, Oryza sativa
VGAFFKSSHLKSQLTADMRRRLSPALSSFPDSSLLHVQHLAKSVVFEILVRGLIGLEAGEEMQQLKQQFQEFIVGLMSLPIKLPGTRLYRSLQAKKKMARLIQRIIREKRARRAAASPPRDAIDVLIGDGSDELTDELISDNMIDLMIPAEDSVPVLITLAVKFLSECPLALHQLEEENIQLKRRKTDMGETLQWTDYMSL

SEQ ID NO: 2183 - protein, 76 aa, Oryza sativa
MARAGGHGMGNPVNVGIAVQADWENREFISNISLNVRRLFDFLLRFEATTKSKLASLNEKLDILERKLEVLEVQVS

SEQ ID NO: 2184 - protein, 276 aa, Zea mays
NIGSFEDILFANNDMEDSPVIVALFPACRESQLYVGLSFLDMTNRKLGLAEFPEDSRFTNVESALVALGCKECLLPADCEKSIDLNPLQDVISNCNVLLTEKKKADFKSRDLAQDLGRIIRGSVEPVRDLLSQFDYALGPLGALLSYAELLADDTNYGNYTIEKYNLNCYMRLDSAAVRALNIAEGKTDVNKNFSLFGLMNRTCTVGMGKRLLNRWLKQPLLDVNEINNRLDMVQAFVEDPELRQGLRQQLKRISDIDRLTHSLRKKSANLQPVVK

SEQ ID NO: 2185 - protein, 176 aa, Oryza sativa
MEVEARRQSAADYIEAVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYGCLRFLPSVVAAS

SEQ ID NO: 2186 - protein, 126 aa, Oryza sativa
LILYRGRNYDPKQRPQIPLMLWKPLAPIYPRLVQNVADGLTFEKTKELRNTGLNSSPLMKLTRNGVYVNVVDRVREAFKTVEVVRLDCSHVGSSDCKKIGVKLRDLVPCVPLLFKDEQIILWRGKV

SEQ ID NO: 2187 - protein, 101 aa, Solanum lycopersicum
SRLLEIHSKMLEINKLEEIRLGLHRSDYMLDEQTKLLLQIELNTISSSFPGLSCLVSELHRSLLQQYREDIASDPNRIPANNAVNQFAEALAKAWNEYGDP

SEQ ID NO: 2188 - protein, 76 aa, Zea mays
YQNTVDSLLESWYPGITYSRYGHELFILCKQTDEFTIDDCDIDNILEVLDLYSVDINWSSDGLLMADNNDKALILH

SEQ ID NO: 2189 - protein, 226 aa, Solanum lycopersicum
EISSKCLHNLLLSEEMIHRNNESPLISTHLRSPNAREFLYSILFLLLVAGYLVRTHLLFVSRASSELQTEFERVKSLMTPSSMIELRKLLDRYPTSEPNSFWLKNLFLVALEQLGDSLEEIRGSASGGNMLGPAYGVKSIRSKKKDWNINLIEIIDLIPNPINRITFSRNTRHLSHTSKEIYSLIRKRKNVNGDWIDEKIESWVANSDSIDDEEREFLVQFSTLTT

SEQ ID NO: 2190 - protein, 101 aa, Oryza sativa
SYASEIYTNLMASELIRRPRSNYMEALQRDITKGMRGILIDWLVEVSEEYKLVPDTLYLTINLIDRFLSQHYIERQKLQLLGITSMLIASKYEEICAPRVE

SEQ ID NO: 2191 - protein, 126 aa, Solanum lycopersicum
NGLMALYDSLFSQLDVTSAQLLVTDNDFRDPDFRRQLNDTVNSLLSLKVIPIFNENDAISTRRAPYEDSSGIFWDNDSLAALLALELKADLLVLLSDVDGLYSGPPRDPDSKLIYTYIKEIHERVI

SEQ ID NO: 2192 - protein, 201 aa, Oryza sativa
RVLLGRYELGGLLGRGASAKVYLARDLLTGRDVAIKSFPNPRHGGGLRGGEEDVLLRPAPIEREAAILPRLRHRHVMRLREILATRKKVHFVLDLAAGGELFSLLDASGRMTEDLARHYFRQLISAVRYCHSRGVYHRDIKPENLLLDDAGDLKVADFGLGAVADGALHHTLCGTPAYVAPEILSRKGYNPAKVDIWSCGV

SEQ ID NO: 2193 - protein, 101 aa, Solanum lycopersicum
SSQHYTLEKAYEICVKKDLLKEQVFILGRMGNAKQALAVIINRLGDIEEAIEFVSMQQDDELWEELIQQSFHKPEMVGVLLEHTVGNLDPLYIVNMLPNDL

SEQ ID NO: 2194 - protein, 176 aa, Zea mays
NGIYITLVKDVRDAFEGSDLVKIDCEGLNPSDYKKIGAKLRDLVPCVLLSFDDEQILMHRGKEWKSRYSKPLTLIPKVPKNNLAMTSVMNSSDEVSDANTQVAIREVLRPKMFKLWKSAVDSSLALLLDDAEANNLTPDSLLTLVEEFSVTSQAVEHSFPALLVTNGDASTDSLSA

SEQ ID NO: 2195 - protein, 201 aa, Zea mays
AAVRALNIAEGKTDVNKNFSLFGLMNRTCTVGMGKRLLNRWLKQPLLDVNEINNRLDMVQAFVEDPELRQGLRQQLKRISDIDRLTHSLRKKSANLQPVVKLYQSCSRIPYIKGILQQYNGQFSTLIRSKFLEPLEEWMAKNRFGRFSSLVETAIDLAQLENGEYRISPLYSSDLGVLKDELSVVENHINNLHVDTASDLD

SEQ ID NO: 2196 - protein, 126 aa, Oryza sativa
ILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLAN

SEQ ID NO: 2197 - protein, 101 aa, Oryza sativa
MAPSFDFAASILLCAEDNTAILDLGEESEEISWVVGVDASLGDLSMDFPLQSDDCIEALLGREEQQHIPMEGYLQRLLLQPDGLDLVAVRSDAIDWIWKVH

SEQ ID NO: 2198 - protein, 126 aa, Oryza sativa
LIDKQFNVVGYTLLLTMIEYKTLVMRGDFDRANALLPSIPKEQHDSVARFLESQGMLEEALEIATDSNYRFDLAVQLGRLEVAKAIAIEAQSESKWRQLGELAMSTGKLDMAEECLLHAMDLSGLL

SEQ ID NO: 2199 - protein, 176 aa, Oryza sativa
MDEDRAVEAAASAWPGPSRRRRLIEFLLHASTRLDLRPVVKYTALSFFADRLLPSLRRKMGFCGARGGRAVTSWLLEPLRDSNLELFALVAVWIASKIHELKPLSVKSLKALGDRIIADQHFTCRDFANAELVFMEVVEYNIGSLNIAFTYLEELLVQFREISKIGDLLNMDVCME

SEQ ID NO: 2200 - protein, 251 aa, Zea mays
SIRNHLANLNKYRDQRDRPDLTAPESLQLYLDTRVEQLKVATELSLWQEAFRSVEDIHGLMTMVKKMPKPSILVVYYAKLTEIFWISDSHLYHAYAWLKLFNLQKSYNKNLSQKDLQLIASSVLLAALSVSPYDKKYGAFETENEKERNMRLSNLVNFSLDNKRENREMPSRPYLLSELASKGVLSCASQEVRDLYNLLEHRFLPLDLASKVQPLLLKISKIGGKLSSASSVPEVKLSQYISALEKLTTLR

SEQ ID NO: 2201 - protein, 276 aa, Oryza sativa
DLVAIASDTSFYILKYNRDVVASYLESGKPVDEEGVEDAFELLHEVNERVRTGIWVGDCFIYNNSSWRLNYCVGGEVTTMYHLDRPMYLLGYLANQSRVYLIDKEFNVMGYTLLLSLIEYKTLVMRGDIERANDILPSIPKAQYNNVAHFLESRGMLEEALEIATDADYRFDLAVQLGKLEVAKAIAMEAQSESKWKQLGELAMSTGKLDMAEECLVQAKDLSGLLLLYSSLGDAEGIEKLASQAKEHGKNNVAFLCLFMLGKLEDCIQLLIDSNR

SEQ ID NO: 2202 - protein, 251 aa, Oryza sativa
RTNCFSVHLESLDDQTIYEYDVCVTPEVGINRAVIRELVKQQKDSGLGGRLPAYDGRKRLYTSGPLPFDSHRFLVLLDSIEDSPEESRHLRVRDFVVTLKFAAKISLWTLRKFRGGKPNRESRAALRALDVVLKELPTARYTQFAGSFYSPNLGECRQLCKVLESWRGFHQRIQATQMGLQLNIDVSSSVFIKPVPVVDYVAQLLNEDILLDRPLCSTEFLKIKEALEGLKVQINGILFNTYHVQDLVHQA

SEQ ID NO: 2203 - protein, 226 aa, Oryza sativa
LVNHFSVDYPKESTFFHYEIRIKLGDGPNRKLSKAELLTVKNELFEHESLQELSSAVAYDGERNLYTCAELPEDCIVPVSKFRVKDSSRTYIVSVKLKKPLPLSQLLEQRPGPRDVMQGLDVIVREASSFGKIVLGQGFYPQSGSEAISDSNIVALKGTQQSLKCTQKGLILCVDYSVLPCWKAGSVLDLVKTMKFMEYPLLEDQLKKLNNALKGLCVTVSHRKTE

SEQ ID NO: 2204 - protein, 101 aa, Oryza sativa
VVGAGRGPLVRASLQAAEETGRKLKVYAVEKNPNAVITLHSLIKLEGWESLVTIISSDMRCWEAPEKADILVSELLGSFGDNELSPECLDGAQRFLKPDGI

SEQ ID NO: 2205 - protein, 201 aa, Oryza sativa
LIDKEFNVMGYTLLLSLIEYKTLVMRGDIERANDILPSIPKAQYNNVAHFLESRGMLEEALEIATDADYRFDLAVQLGKLEVAKAIAMEAQSESKWKQLGELAMSTGKLDMAEECLVQAKDLSGLLLLYSSLGDAEGIEKLASQAKEHGKNNVAFLCLFMLGKLEDCIQLLIDSNRIPEAALMARSYLPSKVSEIVAIWRN

SEQ ID NO: 2206 - protein, 76 aa, Oryza sativa
AEVRGVFDNKSPQDHEGLLENLSYMKLVIKETLRLNPVLPLLLPHLCRETCEIGGYEIVEGTRVLINSWAMARSPE

SEQ ID NO: 2207 - protein, 176 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSAS

SEQ ID NO: 2208 - protein, 176 aa, Zea mays
VSLCQILRASKLNIVDFFKEMPQFCIKVAHILTGLYGSDWEKRLELKELQANVVHLSLLSSYYKRAYQELFLSNDGKSSDNSSESNNQEASDYYRFGWLLFLVLRIQTFSRFKDLVTSTNELVSVLAVLIIHVPVRLRNFDIKDSSYFGKKSDRGVSLIASLCEKHHTSEDELSKA

SEQ ID NO: 2209 - protein, 76 aa, Zea mays
QIFDSWATELSPADFEEFSLPYLKQIVDSVRETHPDLPLILYASGSGGLLERLPLTGVDVVSLDWTVDMAEGRKRL

SEQ ID NO: 2210 - protein, 151 aa, Zea mays
GRQEEVRLVMDKIRAAATAAPPAAVDLSDLLSGYTNDVVSRAVLGASHRNQGRNRLFSELTEINVSLLAGFNLEDYFPPNMAMADVLLRLVSVKARRLNQRWNDVFDELIQEHVQSRPSGESEESEADFIHVLLSIQQEYGLTTDNLKAIL

SEQ ID NO: 2211 - protein, 226 aa, Solanum lycopersicum
LSNSLNFYSPTRFLEPHLLKSSKIFIPKSPLKCAKVPEMQTQLEDSAKPIVDPHDIDSKLVQKLANDALVWCPLRGLLVGDRNSERSGTIPGVDMVHAPVALIPMSFPESHWKQACEVAPIFNELVDRVSQDGEFLQQSLSRTRKADPFTSRLLEIHSKMLEINKLEEIRLGLHRSDYMLDEQTKLLLQIELNTISSSFPGLSCLVSELHRSLLQQYREDIASDPN

SEQ ID NO: 2212 - protein, 101 aa, Zea mays
EDLQDTDSNLVCDGAFFHVRCACHILNLVAKDGLAVIAGTIEKIKAIVLAVKSSPLQWEELMKCASECDLDKSKGISYDVSTRWNSTYLMLRDALYYKPAL

SEQ ID NO: 2213 - protein, 201 aa, Zea mays
MDPALLDDVIRRLLEVKNLKPGKNAQLSESEIKQLCAAAKEIFLQQPNLLELEAPIKICGDVHGQYSDLLRLFDYGGYPPQANYLFLGDYVDRGKQSLETICLLLAYKVKYPENFFLLRGNHECASVNRIYGFYDECKRRFSVKLWKTFTDCFNCLPVSALIDEKILCMHGGLSPELNKLEQILNLNRPTDVPDTGLLCDL

SEQ ID NO: 2214 - protein, 101 aa, Oryza sativa
CDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKY

SEQ ID NO: 2215 - protein, 276 aa, Oryza sativa
ETLQMDGLDVLHFFIKRLAEVSCTSIKYVMSQVVAAFIPSLERCRERPLVHLGKIVEILEELVVKNIILLKQHIRELPLLPSLPSLSGVNKVIQEARGLMTLQDHLKDAVNGLNHESLNVRYMVACELNKLFNDRRGDITSLIIGEDIADLDIISSLIMSLLKGCAEESRTVVGQRLKLVCADCLGALGAVDPAKFKVMSCERFKIECSDDDLIFELIHKHLARAFRAASDTTVQDSAALAIQELLKLSGCQSLPNESSSCKMSKRGQKLWGRFSS

SEQ ID NO: 2216 - protein, 126 aa, Oryza sativa
ITLVHREGNAVIRRHLESLPLESFDSILILADESVEDSAIQADSRSLATLLLIRDIQAKRLPFREAMVSHVTRGSFCEGSWIGEMQQASDKSVIISEILDPRTKNLLSVSKISDYVLSNELVSMAL

SEQ ID NO: 2217 - protein, 151 aa, Oryza sativa
KKLLIFDAEEYLAESLAKYTARLSGEAVAERGAFTVALSGGSLIKALRKLTESPYLEAVEWSKWHVFWVDERVVPKDHADSNYKLAMDGLLSKVPIPASQIYAINDTLSAEGAADEYETCLKQLVNDGVVAISEVTGFPKLDLMLLGMGPD

SEQ ID NO: 2218 - protein, 251 aa, Solanum lycopersicum
LPVLVPYIPTENPRLRDTAYEVALVALATNPSFHKDLLSTVKSWPPRIYSTTPVFSAIEPQINTSSMTDPLKEALAELYVIDGQHDKAFALYADLMKPDLFDFIEKHNLHDAVREKVLQLMMIDCKRAVLLLIQQRDLIPPSEVVSQLIAARDKCDYRYFLHLYLHSLFEVNLHAGKDYHDMQVELYADYDPKMLLTFLRSSQHYTLEKAYEICVKKDLLKEQVFILGRMGNAKQALAVIINRLGDIEEAI

SEQ ID NO: 2219 - protein, 151 aa, Zea mays
VDDTKCLLSLYNAAYVRTHGEKVLDEAITFTRRQLEASLLDPLEPALADEVHLTLQTPLFRRLRILEAINYIPIYGKEAGRNEAILELAKLNFNLAQLIYCEELKEVTLWWKQLNVETNLSFIRDRIVECHFWMTGACCEPQYSLSRVIAT

SEQ ID NO: 2220 - protein, 151 aa, Zea mays
VSDPYITNLTPLSSYRGGYLTSLQRESGDSPTLLSEKDYGVFDIHIDRERSQPVLSAVKKLQWQPYRINKLVYDFIQKHWSVLVSVGLLRPKNLALFKRKEALRLLSSLLFKHEELSTIYRYSELKSVLLKNIHASTFELYTMKIAEAYLD

SEQ ID NO: 2221 - protein, 151 aa, Zea mays
GSDYEIVPINFATAEHKSPEHLVRNPFGQVPALQDGDLYLFESRAICKYAARKNKPELLREGNLEEAAMVDVWIEVEANQYTAALNPILFQVLISPMLGGTTDQKVVDENLEKLKKVLEVYEARLTKCKYLAGDFLSLADLNHVSVTLCLF

SEQ ID NO: 2222 - protein, 76 aa, Oryza sativa
LYYKAIQARRRLHGVLSDIMRERRARGEPGSDLLGCLMQSRAGDDGALLTDEQVADNIIGVLFAAQDTTASVLTWI

SEQ ID NO: 2223 - protein, 126 aa, Oryza sativa
NYQQSLQFRDLDKEKRKILVQVTRNGLRQRVLIDDLLPGDAVHLAVGDQVPADGLFISGFSVLVDESSLTGESEPVFVNEDNPYLLSGTKVLDGSCKMLVTAVGMRTQWGKLMAVLTDGGDDETPL

SEQ ID NO: 2224 - protein, 126 aa, Solanum lycopersicum
SNTLQNVLRKAEEYLIMLPPETPFFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGL

SEQ ID NO: 2225 - protein, 101 aa, Zea mays
RYPPGDPSKRAFAYFVLSGGRFIYASLLRLLVLKFVLSMSASKDVLALASLEVDLSSIEPGTTVTVKWRGKPVFIRRRTEDDIKLANSVDVASLRHPEQDA

SEQ ID NO: 2226 - protein, 151 aa, Zea mays
VDDTKCLLTLYNAAYLRTHGEKVLDEAITFTRRQLEASLLDPLEPALLADEVSLTLQTPLFRRLRILEAINYIPIYGKEAGRNEAILELAKLNFNLAQLIYCEELKEVTLWWKQLNVETNLSFIRDRIVECHFWMTGACCEPQYSLSRVIA

SEQ ID NO: 2227 - protein, 151 aa, Oryza sativa
PCAKLIECIRLVVDKSGQSFLSSDDRDDGSSLLAKSEGLDLPKVGQKRIALDEENSFPKRLKMTEPRFSSGSFMVDELSAGVGQELEKDHGCDFRVQLYSLINCLSPDNHMAYPLEPAISIQVLSLLCLSLSVYPKTNLFSRISKQVLSWI

SEQ ID NO: 2228 - protein, 226 aa, Solanum lycopersicum
METVDSTRAFVKNVKRLIVKVGTAVVTRADGRLALGRLGALCEQLQELNSQGYEVILVTSGAVGVGRQRLRYRKLLNSSFLDLQKPQTELDGKACAAVGQNGLMALYDSLFSQLDVTSAQLLVTDNDFRDPDFRRQLNDTVNSLLSLKVIPIFNENDAISTRRAPYEDSSGIFWDNDSLAALLALELKADLLVLLSDVDGLYSGPPRDPDSKLIYTYIKEIHERVI

SEQ ID NO: 2229 - protein, 151 aa, Solanum lycopersicum
RDVDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGATVVHIELRIICPGEGLPPELVQDMFHSSRWVTQEGLGLSMCRKMLKLMNG

SEQ ID NO: 2230 - protein, 151 aa, Zea mays
ALAVASWGVDYVVLTSVDRDDLPDGGSSHFAQTVKALKELKPGILVECLTSDFRGDLEAISSLASSGLDVYAHNIETVRSLQRIVRDPRAGYDQSLAVLKHAKACREGMVTKSSIMLGLGETDEEVKQAMMDLRAIGVDILTLGQYLQPTE

SEQ ID NO: 2231 - protein, 251 aa, Solanum lycopersicum
AGDEPLYYIVSPKDVVIAKPRDAEDHINWLLQHGWHEKALEAVEANQGQSELLDEVGSRYLDHLIVERKYAEAASLCPKLLRGSASAWERWVFHFAHLRQLPVLVPYIPTENPRLRDTAYEVALVALATNPSFHKDLLSTVKSWPPRIYSTTPVFSAIEPQINTSSMTDPLKEALAELYVIDGQHDKAFALYADLMKPDLFDFIEKHNLHDAVREKVLQLMMIDCKRAVLLLIQQRDLIPPSEVVSQLIAA

SEQ ID NO: 2232 - protein, 126 aa, Solanum lycopersicum
LGGMLTNWSTTETRLHKFRDLRMEQKTGRLNRLPKRDAAMLKRQLSRLQTYLGGIKYMTGVPDIVIIVDQHEEYTALRECITLGIPTICLTDTNCDPDLADISIPANDDAISSIRLILNKLVFAIC

SEQ ID NO: 2233 - protein, 126 aa, Oryza sativa
KLRFEAIVCLLDRIPITLQQIDMFGQDVAFRTKRIGNIEALLDFLKGSAAATWGARAGAGEPIDASSPELHRLVEDAETAYRDVRGLQPRMVVQMPRVFHKVCLPKLHQLLVIARRLLAQNVALRR

SEQ ID NO: 2234 - protein, 76 aa, Zea mays
DLKAEDKTKSWRKLVNVAVSGAAGMISNHLLFKLASGEVFGQDQPIALKLLGSERSFQALEGVAMELEDSLYPLLR

SEQ ID NO: 2235 - protein, 226 aa, Oryza sativa
DLVTIASDTSFYILKYNRDVVSSHLDGGGSVGEEGVEDAFELLHEINERIRTGLWVGDCFIYNNSSSRLNYCVGGEVTTLFHLDRQMYLLGYLANQSRVYLIDKQFNVVGYTLLLTMIEYKTLVMRGDFDRANALLPSIPKEQHDSVARFLESRGMLEEALEIATDSNYRFDLAVQLGRLEVAKAIAIEAQSESKWRQLGELAMSTGKLDMAEECLLHAMDLSGLL

SEQ ID NO: 2236 - protein, 126 aa, Oryza sativa
TYLDRFLARRCVDRDKEWALQLLSVACLSLAAKVEERRPPRLPEFKLDMYDCASLMRMELLVLTTLKWQMITETPFSYLNCFTAKFRHDERKAIVLRAIECIFASIKVISSVGYQPSTIALAAILI

SEQ ID NO: 2237 - protein, 176 aa, Zea mays
VLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIA

SEQ ID NO: 2238 - protein, 101 aa, Oryza sativa
FGEDALKIPPSESYCLSHPIRRGHFNISQDYSLHQVLEDLRTIWNWILTEKLHINPRDRHLYSAILVLGETFDNREIKEMLSIVLCDLGFSTAVIHQEALA

SEQ ID NO: 2239 - protein, 176 aa, Oryza sativa
TYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLFEVTVDPASHPQLHVFLQQVVGLDLV

SEQ ID NO: 2240 - protein, 126 aa, Oryza sativa
SRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSNEW

SEQ ID NO: 2241 - protein, 201 aa, Oryza sativa
EDPQLCATLAFDIYKHLRVAETKKRPSTDFVETIQKNIDTSMRAVLIDWLVEVTEEYRLVPETLYLTVNYIDRYLSSKVINRRKMQLLGVACLLIASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFI

SEQ ID NO: 2242 - protein, 101 aa, Solanum lycopersicum
IPVVRKIKNQINDIREQGALTDCLELLDLSVDLVCDSIAAIDKRSRSEHANAQSWLSGVLTNHVTCLDELDSFTKAMINGTNLDELISRAKVALAMLASVT

SEQ ID NO: 2243 - protein, 276 aa, Oryza sativa
VIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSR

SEQ ID NO: 2244 - protein, 101 aa, Solanum lycopersicum
VFVQMQQKKDMDQQSKLSDELRQISAGQTVLDLVVIGCGPAGLALAAESAKLGLNVGLVGPDLPFTNNYGVWEDEFKDLGLQACIEHVWRDTIVYLDDDEP

SEQ ID NO: 2245 - protein, 226 aa, Solanum lycopersicum
IGTLFHCDANKWASIGETDAREMAVAARACSRRLQALSSQERSKILQDIADALEANEKAILAENEADVVAAQQAGYEKSLISRLALNPGKISSLANSVRVLSNMDEPLGHTLKRTEIADGFILEKSSSPLGVVLIIFESRPDALVQIASLAVRSGNGLMLKGGKEAKRSNAILHKVITSAIPVSVGERLIGLVTSREEIPELLKLDDVIDLVIPRGSNKLVSQIKA

SEQ ID NO: 2246 - protein, 176 aa, Zea mays
PKKISIYNEEMIVARCFIGFLILSWKSLGKTFKETLDGRIESIQESLQQFFNPNEVILEESNEQQRLLNLWISLRICSTVKVVESLPAARCAPKCEKTVQALLCRNLNVKSATLLNATSSRRIRLQDDIVTGFHFSVSERLVSGSTTLVEASTVEQIREAFLLEPRDLIREGFIVL

SEQ ID NO: 2247 - protein, 276 aa, Oryza sativa
ADLISEKELVYEELKSTQEKMQQEMRHRQGLEDEILRLKQSLADNCSEESKALCGMVRSGSGLGSVPFMSKSGKSRELLSSQRSNISKIFEEVGLPNVLALLKSDELEVQIHAVKVVANLAAEDVNQEKIVEEGGLDALLSLLETSENTTIHRVTAGAIANLAMNGSNQGLIMNKGGARLLANIASKTNDPQTLRMVAGALANLCGNEKLHVMLKQDGGIKALLGMFRTGHNEVIAQIARGMANFAKCESRVISQGHRKGRSLLIEEGVLNWMVAN

SEQ ID NO: 2248 - protein, 276 aa, Solanum lycopersicum
TENRIDQILLSLTHSDHLSKNDSGYQMIEQPGAIYLRYLVDIHKKHLMNYEFNPSCLAERRIFLAHYQTITYSQTSCGENSFHFPSHGKPFSLRLALSPSRGILVIGSIGTGRSYLVKYLATNSYVPFITVFLNKFLDNKSKGFLLDEIDIDDSDDIDDSDNLDASDDIDRDLDTELELLTRMNGLTVDMMPEIDRFYITLQFELAKAMSPCIIWIPNIHDLDVNESNDLSLGLLVNHLSRDCERCSTRNILVIASTHIPQKVDPALIAPNKLNTC

SEQ ID NO: 2249 - protein, 151 aa, Oryza sativa
GRRVIYGTPESATAARKLLDRQMSINSVPKKVIASLLKPRGWKPPVRRQFFLDCNEIADLCDSAERIFSSEPSVLQLKAPIKIFGDLHGQFGDLMRLFDEYGAPSTAGDIAYIDYLFLGDYVDRGQHSLETITLLLALKVEYPLNVHLIRG

SEQ ID NO: 2250 - protein, 226 aa, Oryza sativa
DLVTIASDTSFYILKYNRDVVSSHLDGGGSVGEEGVEDAFELLHEINERIRTGLWVGDCFIYNNSSSRLNYCVGGEVTTLFHLDRQMYLLGYLANQSRVYLIDKQFNVVGYTLLLTMIEYKTLVMRGDFDRANALLPSIPKEQHDSVARFLESQGMLEEALEIATDSNYRFDLAVQLGRLEVAKAIAIEAQSESKWRQLGELAMSTGKLDMAEECLLHAMDLSGLL

SEQ ID NO: 2251 - protein, 151 aa, Oryza sativa
VLGRAGSGAYADVYRGRRRSDGAPVALKEVHDAVSARREADALLAAAPSRHVVALLDHFPGGDHDDDVLVLEWLPLDLSAVVRAAAAARPSALPAAQRKRWMLQVLEGVAACHSAGVVHRDLKPANLLISEDGVLKVADLGQARILQETGT

SEQ ID NO: 2252 - protein, 151 aa, Zea mays
VDDTKCLLSLYNAAYFRTHGEKVLDEAIAFTRRQLEASLLDPLEPALADEVHLTLQTPLFRRLRILEAINYIPIYGKEAGRNEAILELAKLNFNLAQLIYCGELKEVTLWWKQLNVETNLSFIRDRIVECHFWMTGACCEPQYSLSRVIAT

SEQ ID NO: 2253 - protein, 151 aa, Oryza sativa
VLACVKQFMMKKNDLRLILMSATADITRYKDYFRDLGRGERVEVIAIPSSPRSSIFQRKVLYLEQIVDILKMDSESLSTKYCSGPNTAADAGLKPDVYELIHRLLLHIHQNEPDIGKSILVFLPTYYALEQQWIRLLSASSMFKVHILHRS

SEQ ID NO: 2254 - protein, 151 aa, Oryza sativa
DVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPP

SEQ ID NO: 2255 - protein, 151 aa, Zea mays
NLMTTSADEGQFLNMLIKLIGAKKTMEIGVYTGYSLLATALALPEDGTILAMDINRENYELGLPCINKAGVGHKIDFREGPALPVLDDLVADKEQHGSFDFAFVDADKDNYLNYHERLLKLVRPGGLIGYDNTLWNGSVVLPDDAPMRKYI

SEQ ID NO: 2256 - protein, 276 aa, Solanum lycopersicum
GPQELNLIIAKCTRIEIHLLTPQGLQPMLDVPIYGRIATLELFRPHGETQDLLFIATERYKFCVLQWDTEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGRVDADGSRYLLGDHNGLLHLLVITHEKEKVTGLKIELLGETS

SEQ ID NO: 2257 - protein, 251 aa, Solanum lycopersicum
ILQSPGIYYRSELDHNGISVYTGTIISDWGGRSELEIDRKARIWARVSRKQKISILVLSSAMGLNLREILENVCYPEIFLSFLNDKERKKIGSKENSILEFYQQFACVGGDPVFSESLCKELQKKFFQQRCELGRIGRRNMNRKLNLDIPQNNTFLLPRDILAAADHLIGLKFGMGALDDMNHLKNKRIRSVADLLQDQFGLALVRLENVVRGTICGAIRHKLIPTPQNLVTSPPLTTTYESFFGLHPLSQ

SEQ ID NO: 2258 - protein, 101 aa, Zea mays
ICLLLAYKVKYPENFFLLRGNHECASVNRIYGFYDECKRRFSVKLWKTFTDCFNCLPVSALIDEKILCMHGGLSPELNKLEQILNLNRPTDVPDTGLLCDL

SEQ ID NO: 2259 - protein, 176 aa, Zea mays
IPWAEARKVEASKLYYRVLEAICRAELQNSNVNNLTPLLSNERFHRCLIACSADLVLATHKTVIMMFPAVLESTGLTAFDLSKIIENFVRHEETLPRELKRHLNSLEEQLLESMAWEKGSSLYNSLIVARPSVASEINRLGLLAEPMPSLDDLVSRQNVRIEGLPATPSKKRAAGP

SEQ ID NO: 2260 - protein, 101 aa, Solanum lycopersicum
KIKNQINDIRQQGALTDCLELLDQSVDLVSDSIAAIDKRSRSEHANAQSWLSGVLTNHVTCLDELTSFSLSTKNGTVLDELITRAKVALAMLASVTTPNDE

SEQ ID NO: 2261 - protein, 76 aa, Oryza sativa
KSWACVNLCEGLDNRVVEAFCLQLVRTSKITGLDFANVSLPILKADPHNVKTDLPMRYQEACSWSRDNKIDLLLVV

SEQ ID NO: 2262 - protein, 76 aa, Zea mays
NDAEKLVTIGSHVLREGEWLSLNGSTGEVILGKQPLSPPALSGDLGTFMAWVDDVRKLKVLANADTPDDALTARNN

SEQ ID NO: 2263 - protein, 126 aa, Solanum lycopersicum
SDPLPEVERPLFELVSAAQTLLPDSEGAIDGHLREVGLTFHLLKDVPGLISKNIEKSLIEAFQPLGISDWNSIFWIAHPGGPAILDQVELKLSLKPEKLRATRQVLSDYGNMSSACVLFILDEMRK

SEQ ID NO: 2264 - protein, 176 aa, Zea mays
VLGGKCNRGLSVVDSYKLLKGADALGEEETFLACTLGWCIEWLQAFFLVLDDIMDDSHTRRGQPCWFRVPQVGLIAANDGIILRNHISRILRRHFKGKPYYADLLDLFNEVEFKTASGQLLDLITTHEGEKDLTKYNITVHGRIVQYKTAYYSFYLPVACALLLSGENLDNYGDVE

SEQ ID NO: 2265 - protein, 101 aa, Oryza sativa
SPEKTLEQLGLAGGKLGYVVVVGKKGVECLPLAGGRLSSGIAAMSVEMSEVAPPLLLVELRLEVAAGDVDGGDGEVKGFGWEQLRMELGDVVRAWHSCEDL

SEQ ID NO: 2266 - protein, 101 aa, Oryza sativa
ELAMSTGKLDMAEECLVQAKDLSGLLLLYSSLGDAEGIEKLASQAKEHGKNNVAFLCLFMLGKLEDCIQLLIDSNRIPEAALMARSYLPSKVSEIVAIWRN

SEQ ID NO: 2267 - protein, 76 aa, Solanum lycopersicum
SKNIEKSLLEAFQPLGISDWNSLFWIAHPGGPAILDQVELKLGLKPEKLRATREVLSNYGNMSSACVLFILDEMRK

SEQ ID NO: 2268 - protein, 176 aa, Oryza sativa
RPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKF

SEQ ID NO: 2269 - protein, 101 aa, Oryza sativa
LETLAERLLDLLCENLGLEKGYLTKAFRGPAGAPTFGTKVSSYPPCPRPDLVEGLRAHTDAGGIILLFQDDRVGGLQLLKDGEWVDVPPMRHSIVVNLGDQ

SEQ ID NO: 2270 - protein, 101 aa, Oryza sativa
YGAPSTAGDIAYIDYLFLGDYVDRGQHSLETITLLLALKVEYPLNVHLIRGNHEAADINALFGFRIECIERMGERDGIWTWHRMNRLFNWLPLAALIEKKI

SEQ ID NO: 2271 - protein, 201 aa, Oryza sativa
MAPSFDFAASILLCAEDNTAILDLGEESEEISWVVGVDASLGDLSMDFPLQSDDCIEALLGREEQQHIPMEGYLQRLLLQPDGLDLVAVRSDAIDWIWKVHELYKFGPLTAVLSVNYLDRFLSVFDLPQEEACMTQLLAVASLSLAAKMEETVVPHPLDLQVCDAKYVFETRTIKRMELAVLNALKWRMQAVTACSFIDYY

SEQ ID NO: 2272 - protein, 101 aa, Oryza sativa
LKPLSVKSLKALGDRIIADQHFTCRDFANAELVFMEVVEYNIGSLNIAFTYLEELLVQFREISKIGDLLNMDVCMEILDILYETEDSSWLFNSPCQLAASA

SEQ ID NO: 2273 - protein, 126 aa, Oryza sativa
LLLDEEGRLKVTDFGLAALPEQLRQDGLLHTQCGTPAYVAPEVLRKRGYDGARADLWSCGVVLYVLLCGFLPFQHENYAKMYQKIFKAEYQVPPWVSGDARRLIVRLLVVDPAKRISIPEIMRTPW

SEQ ID NO: 2274 - protein, 151 aa, Oryza sativa
NFSARCDVRNLIRDLIRNASAKGIQMAEPFDVFEESPSLRRAPVSRRVDDMFEQIKSKLPGAPKFLLCLLPERKNCEVYGPWKRKCLAEFGIVTQCLAPQRVNDQYLLNLLLKINAKLGGINSLLQIEASPSIPLVSKTPTIILGMDVSHG

SEQ ID NO: 2275 - protein, 76 aa, Oryza sativa
EIVAERRARGGGGGGGGDDLLGGLMRSRDDGTAGAVALLTDDQIADNVVGVLFAAQDTTASVLTWILKYLHDSPKL

SEQ ID NO: 2276 - protein, 251 aa, Zea mays
LNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGV

SEQ ID NO: 2277 - protein, 176 aa, Oryza sativa
DPIRKTDSAELVWVSKSQAEQRKGRTGRTCDGQIYRLVTGPFYNSLTDHEYPAILRLSLREQVLMICCAESRAMNDPHVLLQKVLDPPDSDVVEDALESLVQIRALDKPTSPRGRHEPTFYGCLLNSLPLSFDASVLALKFGDTGSICEGILISIMLDIQPLPIVQPFGHQQLCKM

SEQ ID NO: 2278 - protein, 76 aa, Oryza sativa
KGVMEAMKQPYSQSEVKCLMLQLLEGVKYLHDNWVLHRDLKTSNLLLNNRGELKICDFGLSRQYGSPLKPYTQLVV

SEQ ID NO: 2279 - protein, 101 aa, Solanum lycopersicum
LSNSLNFYSPTRFLEPHLLKSSKIFIPKSPLKCAKVPEMQTQLEDSAKPIVDPHDIDSKLVQKLANDALVWCPLRGLLVGDRNSERSGTIPGVDMVHAPVA

SEQ ID NO: 2280 - protein, 251 aa, Oryza sativa
PCAKLIECIRLVVDKSGQSFLSSDDRDDGSSLLAKSEGLDLPKVGQKRIALDEENSFPKRLKMTEPRFSSGSFMVDELSAGVGQELEKDHGCDFRVQLYSLINCLSPDNHMAYPLEPAISIQVLSLLCLSLSVYPKTNLFSRISKQVLSWIPWICKQTTKICMFSFDVSLYFEAVQTVMLLQSFLPGHTKLFEDEPLLIGNGCTDFEYPRYADLINLLKLVSDDGYLTSQTCSEKLKCLAVQIIAKIGSRQ

SEQ ID NO: 2281 - protein, 126 aa, Solanum lycopersicum
EISSKCLHNLLLSEEMIHRNNESPLISTHLRSPNAREFLYSILFLLLVAGYLVRTHLLFVSRASSELQTEFERVKSLMTPSSMIELRKLLDRYPTSEPNSFWLKNLFLVALEQLGDSLEEIRGSAS

SEQ ID NO: 2282 - protein, 226 aa, Solanum lycopersicum
YRNNTLTDLLTTSRSTPGELVMCQEKLVQEAVDTLLDNGIRGQPMRDGHNKVYKSFSDVIEGKEGRFRETLLGKRVDYSGRSVIVVGPSLSLHRCGLPREIAIELFQTFVIRGLIRQHLASNIGVAKSKIREKEPIVWEILQEVMQGHPVLLNRAPTLHRLGIQAFQPVLVEGRAICLHPLVCKGFNADFDGDQMAVHVPLSLEAQVEARLLMFSHMNLLSPAIGD

SEQ ID NO: 2283 - protein, 76 aa, Solanum lycopersicum
GKGVAIVWFRNDLRVLDNEALLRAWVSSEAILPVYCVDPRLFGTTHYFGMPKTGALRAQFIIECLNDLKRNLVKRG

SEQ ID NO: 2284 - protein, 126 aa, Oryza sativa
GEGTYGLVFLARLKQSHPHAAAGVGRRGSPIAIKKFKQSKEGDGVSPTAIREIMLLREINHENVVKLVNVHINHADMSLYLAFDYAEHDLYEIIRHHREKLNLPINPYTVKSLLWQLLNGLNYLHS

SEQ ID NO: 2285 - protein, 76 aa, Oryza sativa
VFNSYGGFKLLLPQILSRVAQAGEKLHERLAAEIRSAVADAGGNVTLAALEKMELTRSVVWEALRLDPPVRFQYGR

SEQ ID NO: 2286 - protein, 276 aa, Oryza sativa
PGSFGWPVVGETLEFVSCAYSPRPEAFVDKRRKLHGSAVFRSHLFGSATVVTADAEVSRFVLQSDARAFVPWYPRSLTELMGKSSILLINGALQRRVHGLVGAFFKSSHLKSQLTADMRRRLSPALSSFPDSSLLHVQHLAKSVVFEILVRGLIGLEAGEEMQQLKQQFQEFIVGLMSLPIKLPGTRLYRSLQAKKKMARLIQRIIREKRARRAAASPPRDAIDVLIGDGSDELTDELISDNMIDLMIPAEDSVPVLITLAVKFLSECPLALHQLE

SEQ ID NO: 2287 - protein, 251 aa, Zea mays
DRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNS

SEQ ID NO: 2288 - protein, 151 aa, Oryza sativa
EVWTVDVVAELIGGEAERSHSPRADYPGRLRSGRPADLAARADSVAWILKVRELYGMLPVTAYLAVSYMDRFLSLHRLPGNGWAMQLLAVTCLSLAAKMEETLVPSILDLQMEDARYIFEHRTIFRMELLVLDALDWRLRSITPFTFMYLF

SEQ ID NO: 2289 - protein, 76 aa, Oryza sativa
IRELLIGIPPPVAVDRLPSMYFEKYGKPLRPDGWLTESQQHGRTGCSLTSLLMGLNTIRVVEREHGQYHVVLVEDA

SEQ ID NO: 2290 - protein, 276 aa, Zea mays
ALKLYYRVLESMCRAESQILSGNNLTSLLSNERFHRCMIACSAELVLATHKTVTMMFPAVLEKTGITAFDLSKVIEGFVRHEDTLPRELKRHLNSLEERLLESMAWEKGSSMYNSLIVARPALSVEISRLGLLAEPMPSLDAIAAHHNISLGGLPPLPFQKQERLQDKDEVRSPKRACTERRNVLVDSNSLRSPVKDIIKPKLPPLQSAFASPTRPNPAAGGETCAETGIGVFFSKISKLAAIRIRSLCERLQLPQQVLERVYSLVQQILSQQTGL

SEQ ID NO: 2291 - protein, 101 aa, Zea mays
TRPCFPLMLWKPVAPVYPRLVTKVPGGLTPDEATEMRTRGHQLPPICKLGKNGVYANLVNQVREAFEACDLVRVDCSGLNKSDCRKIGAKLKDLVPCILLS

SEQ ID NO: 2292 - protein, 76 aa, Oryza sativa
ELWVRGPAVMTGYVGDNEANATTFNSEGWLKTGDLCYIDQDGFLFVVDRLKELIKYKAYQVPPAELELVLHSLPQI

SEQ ID NO: 2293 - protein, 251 aa, Solanum lycopersicum
  MOD_RES (9)..(9): Any amino acid
EKPHEIVLXPIKDISGTVKLPGSKSLSNRILLLAALSEGRTVVDNLLSSDDIHYMLGALKTLGLHVEDDNENQRAIVEGCGGQFPVGKKSEEEIQLFLGNAGTAMRPLTAAVTVAGGHSRYVLDGVPRMRERPIGDLVDGLKQLGAEVDCSLGTNCPPVRIVSKGGLPGGKVKLSGSISSQYLTALLMAAPLALGDVEIEIIDKLISVPYVEMTLKLMERFGVFVEHSSGWDRFLVKGGQKYKSPGKAFVE

SEQ ID NO: 2294 - protein, 251 aa, Zea mays
RRNNNLAYLLKRSELAPADLVMCQEKLVQEAVDTLLDSGSRGQPTRDGHNKVYKSLSDVIEGKEGRFRETLLGKRVDYSGRSVIVVGPSLSLHQCGLPLEIAIKLFQLFVIRDLITKRATSNVRIAKRKIWEKEPIVWEILQEVMRGHPVLLNRAPTLHRLGIQAFQPTLVEGRTICLHPLVCKGFNADFDGDQMAVHLPLSLEAQAEARLLMFSHMNLLSPAIGDPICVPTQDMLIGLYVLTIGNRLGIC

SEQ ID NO: 2295 - protein, 276 aa, Solanum lycopersicum
VAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSKEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGST

SEQ ID NO: 2296 - protein, 126 aa, Oryza sativa
MPLGQRAGDKSESRYCGVEVLDFPAGEELPAVLSHSLSSSFDFLLAPLVDPDYRPTPGSVLPVAASDLVLGPAQWSSHIVGKISEWIDLDAEDEQLRLDSEITLKQEIAWASHLSLQACVLPPPKR

SEQ ID NO: 2297 - protein, 251 aa, Oryza sativa
IIRSIMCILSQDVNGLSDIRDADYDFSMGACLHALHSSCPGYIVAITASDIVNVFQRAVHTSRSSELQVAMCNAYKRIVELCSPRVWKPEILLKLLCLPKPCAKLIECIRLVVDKSGQSFLSSDDRDDGSSLLAKSEGLDLPKVGQKRIALDEENSFPKRLKMTEPRFSSGSFMVDELSAGVGQELEKDHGCDFRVQLYSLINCLSPDNHMAYPLEPAISIQVLSLLCLSLSVYPKTNLFSRISKQVLSWI

SEQ ID NO: 2298 - protein, 151 aa, Zea mays
EMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWE

SEQ ID NO: 2299 - protein, 176 aa, Zea mays
DLKAEDKTKSWRKLVNVAVSGAAGMISNHLLFKLASGEVFGQDQPIALKLLGSERSFQALEGVAMELEDSLYPLLREVSIGIDPYVVFQDVDWALLIGAKPRGPGMERAALLDINGQIFADQGKALNAVASRNDEVLVVGNPCNTNALICLKNAPNIPAKNFHALTRLDENRAKCQ

SEQ ID NO: 2300 - protein, 201 aa, Oryza sativa
IAKLFEQVGLQKILSLLESEEPDVRVHAVKVVANLAAEEANQEKIVEAGGLTSLLMLLRSSEDETIRRVAAGAIANLAMNETNQDLIMAQGGVSLLSMTASDAEDPQTLRMVAGAIANLCGNDKLQTRLRGEGGIKALLGMVKCGHPDVLAQVARGIANFAKCESRAATQGNKVGKSLLIDDGALPWIVKNANNEAAPIRR

SEQ ID NO: 2301 - protein, 101 aa, Zea mays
QQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSIS

SEQ ID NO: 2302 - protein, 151 aa, Zea mays
DRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTT

SEQ ID NO: 2303 - protein, 151 aa, Zea mays
ALKLYYRVLESMCRAESQILSGNNLTSLLSNERFHRCMIACSAELVLATHKTVTMMFPAVLEKTGITAFDLSKVIEGFVRHEDTLPRELKRHLNSLEERLLESMAWEKGSSMYNSLIVARPALSVEISRLGLLAEPMPSLDAIAAHHNISL

SEQ ID NO: 2304 - protein, 201 aa, Solanum lycopersicum
HLEKKMFHTNGFGSITMGSNARDLVALTNEVLSISITQKKSIIDTNTIRSALHRQTWDLRSQVRSVQDHGILFYQIGRAVAQNVLLSNCPIDPISIYMKKKSCNEGDSYLYKWYFELGTSMKRLTILLYLLSCSAGSVAQDLWSLSVPDEKNGITSYGLVENDSDLVHGLLEVEGALVGSSRTEKDCSQFDNDRVTLLLRP

SEQ ID NO: 2305 - protein, 76 aa, Oryza sativa
CGVELQEQFLTALDVGLKFSGGFCFGDLFPSLRFIDAMTGLRSRLWRARGQLDSVFDKIIAQCEEHQGDSLVNVLL

SEQ ID NO: 2306 - protein, 76 aa, Oryza sativa
AQALCHPWIRGTEEVKLPLDMIIYRLMRAYISSSSLRRAALRALAKTLTTDQIYYLREQFELIGPNKSDLITLQNL

SEQ ID NO: 2307 - protein, 176 aa, Oryza sativa
WVSQPARRLVSRLLDPNPDTRVAVESLAAHHPWFKRSLSVDSQLDGLLNGEPERAVAFQAAPPPPLNAFDIISMSPGLDLSGLFGEHDKSLREKRFTTTASPEKTLEQLGLAGGKLGYVVVVGKKGVECLPLAGGRLSSGIAAMSVEMSEVAPPLLLVELRLEVAAGDVDGGDGEV

SEQ ID NO: 2308 - protein, 151 aa, Solanum lycopersicum
LPVLVPYIPTENPRLRDTAYEVALVALATNPSFHKDLLSTVKSWPPRIYSTTPVFSAIEPQINTSSMTDPLKEALAELYVIDGQHDKAFALYADLMKPDLFDFIEKHNLHDAVREKVLQLMMIDCKRAVLLLIQQRDLIPPSEVVSQLIAA

SEQ ID NO: 2309 - protein, 176 aa, Zea mays
LGPPRFDDREAADRVASPGVSVGLVWTSVGGEVQFVEATAMVGKGDLHLTGQLGDVIKESAQLALTWVRARAADLNLSPTSDINLLESRDIHIHFPAGAVPKDGPSAGVTLVTALVSLFSNRKVRADTAMTGEMTLRGLVLPVGGVKDKVLAAHRYGIKRVILPERNLKDLSEVPL

SEQ ID NO: 2310 - protein, 126 aa, Solanum lycopersicum
PSLDKSEILTVGTDVRTLFTPSSSVLLERAFGAREITLLNPIWIHSKNSGKPFYAILHRVDVGIVIDLEPARTEDPALSIAGAVQSQKLAVRAISHLQSLPGGDIKLLCDTVVESVRELTGYDRVM

SEQ ID NO: 2311 - protein, 101 aa, Oryza sativa
NFRSRHEIIFDTVWSLLSLLRTGDREAYRQFFLDVMVAVQDVLYVVASMHGDRPSGVLTERYLVKCLCGSFSDILDSPGIFSDLPDSCQPKNGPGVLVDLT

SEQ ID NO: 2312 - protein, 226 aa, Zea mays
SDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMV

SEQ ID NO: 2313 - protein, 101 aa, Zea mays
EDMESDPAAAREKELELERVQSWREQVTLRGVVAALLIGFMYSVIVMKIALTTGLVPTLNVSAALMAFLALRGWTRVLERLGVAHRPFTRQENCVIETCAV

SEQ ID NO: 2314 - protein, 151 aa, Oryza sativa
GIVAGGAPDPDDYDADVPLNDEARQPLSRKVSIASSKVNPYRMVIILRLVVLGFFLRYRILHPVPDAIPLWLTSIICEIWFAVSWILDQFPKWYPIDRETYLDRLSLRYEREGEPSLLSAVDLFVSTVDPLKEPPLVTANTVLSILAVDYP

SEQ ID NO: 2315 - protein, 176 aa, Oryza sativa
VIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLL

SEQ ID NO: 2316 - protein, 251 aa, Oryza sativa
TKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLV

SEQ ID NO: 2317 - protein, 151 aa, Zea mays
LNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDIT

SEQ ID NO: 2318 - protein, 76 aa, Solanum lycopersicum
KSCNEGDSYLYKWYFELGTSMKRLTILLYLLSCSAGSVAQDLWSLSVPDEKNGITSYGLVENDSDLVHGLLEVEGA

SEQ ID NO: 2319 - protein, 151 aa, Oryza sativa
FAAKISLWTLRKFRGGKPNRESRAALRALDVVLKELPTARYTQFAGSFYSPNLGECRQLCKVLESWRGFHQRIQATQMGLQLNIDVSSSVFIKPVPVVDYVAQLLNEDILLDRPLCSTEFLKIKEALEGLKVQINGILFNTYHVQDLVHQA

SEQ ID NO: 2320 - protein, 201 aa, Oryza sativa
SYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNVPSITLGYLANYLAELTLIDYSFLKFLPSVVAASAVFLARWTLDQSDIP

SEQ ID NO: 2321 - protein, 276 aa, Oryza sativa
HISLKYRTDSEGLQQQEILDSLPKAIKSSISQYLFFHLVQNVYLFQGVSNDLIFQLVSEMKAEYFPPREDVILQNEAPTDFYILVSGSVELVEQQNGADQVIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLL

SEQ ID NO: 2322 - protein, 101 aa, Zea mays
MSNVFLPGELIGLLRAERAGRALDESIYYRAILLGITRASLNTQSFISEASFQETARVLAKAALRGRIDWLKGLKENVVLGGIIPVGTGFQKFVHRSPQDK

SEQ ID NO: 2323 - protein, 251 aa, Zea mays
VLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDIT

SEQ ID NO: 2324 - protein, 101 aa, Oryza sativa
SNPAADCSGAFSDDDISFLMEIYGGLDEPDGLLGLANLRKSSTLQDQLIINEKAGNWAEVLTLCEQSLQMEPDSVHRHCDVLNCLLNMCHLQAMIAHVDGL

SEQ ID NO: 2325 - protein, 126 aa, Oryza sativa
VREYAARNFCYDLGFMCRESGMVFSVKPVLPLVIAKPGCVESALRTLHDDVMDILRPQGRKLDLLIVILPNNNGSLYGDVKRICETDIGLISQCCLAKHVLKMNKWYLASVALKINAKMGGRNTVL

SEQ ID NO: 2326 - protein, 126 aa, Oryza sativa
DLVTIASDTSFYILKYNRDVVSSHLDGGGSVGEEGVEDAFELLHEINERIRTGLWVGDCFIYNNSSSRLNYCVGGEVTTLFHLDRQMYLLGYLANQSRVYLIDKQFNVVGYTLLLTMIEYKTLVMR

SEQ ID NO: 2327 - protein, 126 aa, Oryza sativa; identical to SEQ ID NO: 2326

SEQ ID NO: 2328 - protein, 76 aa, Zea mays
AWLGGQLFSAMVVRRPAHLFLDELGVGYDEAEDYVVVKHAALFTSTVMSRLLARPNVKLFNAVAVEDLIVRRGRVG

SEQ ID NO: 2329 - protein, 101 aa, Solanum lycopersicum
LQKCIALTEETTKGNKGLHLVIALNYGGYYDILQATKSIVNKAMNGLLDVEDINKNLFDQELESKCPNPDLLIRTGGEQRVSNFLLWQLAYTEFYFTNTLF

SEQ ID NO: 2330 - protein, 76 aa, Zea mays
QVAIREVLRPKMFKLWKSAVDSSLALLLDDAEANNLTPDSLLTLVEEFSVTSQAVEHSFPALLVTNGDASTDSLSA

SEQ ID NO: 2331 - protein, 101 aa, Oryza sativa
MDEAWERAVEAALQAAGEGSSSPARSLTLDGAVKCLHGRLPAAEILERYQSLEHLSIAGVGVASLAGFPRLRNLTRLTLSDNRIAGGLDHLVAAGLASLRD

SEQ ID NO: 2332 - protein, 151 aa, Zea mays
EWEDYLFHLVHPDGLADHALWPAYPPDYIAATRDFGRRTRDLASTLLAILSMGLLGTDRGDALEKALTTTTTRTAADDDLLLQLKINYYPRCPQPELAVGVEAHTDVSALSFILHNGVPGLQVLHGARWVTARHEPGTIIVHVGDALEILS

SEQ ID NO: 2333 - protein, 176 aa, Solanum lycopersicum
DLAENNKGARVLVVCSEITAVTFRGPSESHLDSLVGQALFGDGAAAIIIGSDPIIGVERPLFELVSAAQTLVPDSEGAIDGHLREVGLTFHLLKDVPGLISKNIEKSLLEAFQPLGISDWNSLFWIAHPGGPAILDQVELKLGLKPEKLRATREVLSNYGNMSSACVLFILDEMRK

SEQ ID NO: 2334 - protein, 101 aa, Solanum lycopersicum
LEDDIYNNSAWNQRYFVVTRSPLLGGLVAMRELEVNYTVQAIRASPENESPWRYLRGLYKNDTQSLVQDSQVASVLWDVLTSQNSHVHALRFLLDLLCHDL

SEQ ID NO: 2335 - protein, 151 aa, Solanum lycopersicum
DSVRQRFLSILEQLGLEPQRVDLLPLILLNHDHMQAYSLMDISLDTFPYAGTTTTCESLYMGVPCVTMGGSVHAHNVGVSLLKTVGLENLVARNEDEYVESAIQLASDVTSLSNLRMSLRELMSKSPLCDGAKFTRNIESIYRSMWRRYCD

SEQ ID NO: 2336 - protein, 76 aa, Oryza sativa
PSAGISDFRDLLMDSISPDNFEGLILIYPLLRHKWDTNTSVVLPDSGSTDQVMYAVGILRSANPDDGCSHHCLQEL

SEQ ID NO: 2337 - protein, 126 aa, Oryza sativa
LPLSQLLEQRPGPRDVMQGLDVIVREASSFGKIVLGQGFYPQSGSEAISDSNIVALKGTQQSLKCTQKGLILCVDYSVLPCWKAGSVLDLVKTMKFMEYPLLEDQLKKLNNALKGLCVTVSHRKTE

SEQ ID NO: 2338 - protein, 176 aa, Zea mays
LESMAWEKGSSMYNSLIVARPALSVEISRLGLLAEPMPSLDAIAAHHNISLGGLPPLPFQKQERLQDKDEVRSPKRACTERRNVLVDSNSLRSPVKDIIKPKLPPLQSAFASPTRPNPAAGGETCAETGIGVFFSKISKLAAIRIRSLCERLQLPQQVLERVYSLVQQILSQQTGL

SEQ ID NO: 2339 - protein, 151 aa, Oryza sativa
RVQRWVVVNFSAQCNAHHLAQRLIHCGNLKGLPVDPEDHVFQERSHMGRERAETRVNDMFQQLLSGDKPSFVLCVLPERKNCDIYGPWKRMCLVKYGIVTQCLAPTKINDQYLTNVLLKINAKLGGLNSLLQIERNQAIPLLSKTPTIILG

SEQ ID NO: 2340 - protein, 101 aa, Zea mays
ATGCVMARICHTNNCPVGVASQREELRARFPGVPGDLVNYFLFVAEEVRAALAQLGYEKLDDIIGRTDLLKPKHISLVKTQHIDLGYLLSNAGLPEWSSSQ

SEQ ID NO: 2341 - protein, 251 aa, Solanum lycopersicum
ILKENPNMCAYMAPSLDARQDIVVVEVPKLGKRGTQKAIKEWGQPKSKITHLVFCTTSGVDMPACDYQLAKLLPVRPSVKRLMMYQQGCFAGGTVLRLAKDLAENNKGARVLVVCSEITAVTFRGPSESHLDSLVGQALFGDGAAAIIIGSDPIIGVERPLFELVSAAQTLVPDSEGAIDGHLREVGLTFHLLKDVPGLISKNIEKSLLEAFQPLGISDWNSLFWIAHPGGPAILDQVELKLGLKPEKLRA

SEQ ID NO: 2342 - protein, 126 aa, Oryza sativa
GGGDVDLRVRSEAIGWIWEVYTYYNFSSVTAYLAVNYLDRFLSQYELPEGRDWMTQLLSVACLSIAAKMEETVVPQCLDLQIGEPRFLFEVETIHRMELLVLTNLNWRMQAVTPFSYIDYFLRKLN

SEQ ID NO: 2343 - protein, 201 aa, Solanum lycopersicum
RTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILK

SEQ ID NO: 2344 - protein, 201 aa, Zea mays
EEAAAASEELPVMPWATSVASGYTLLRDPHHNKGLAFTEEERDGHYLRGLLPPAVLSQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITID

SEQ ID NO: 2345 - protein, 101 aa, Oryza sativa
FVLTNERFLVPEMLFHPIDLGMNQAGLAECIVRAIQACHPHLQPVLFERIILTGGSTLFPRFTERLEKELRPLVPDDYQVKIIAQEDPILGAWRGGSLLAH

SEQ ID NO: 2346 - protein, 151 aa, Zea mays
ALGLRPSVNRLMMYQQGCFAGGTVLRVAKDLAENNRGARVLVVCSEITAVTFRGPSESHLDSLVGQALFGDGAAAVVVGADPDDRVERPLFQLVSAAQTILPDSEGAIDGHLREVGLTFHLLKDVPGLISKNIGRALDDAFKPLGISDWNS

SEQ ID NO: 2347 - protein, 176 aa, Solanum lycopersicum
CPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYL

SEQ ID NO: 2348 - protein, 251 aa, Zea mays
KNMLTVPSSPLSPATGGSVKIVQMTPVTSAMTTAKWLREVISSLPDKPSSKLQQFLSSCDRDLTNAVTERVSIVLEAIFPTKSSANRGVSLGLNCANAFDIPWAEARKVEASKLYYRVLEAICRAELQNSNVNNLTPLLSNERFHRCLIACSADLVLATHKTVIMMFPAVLESTGLTAFDLSKIIENFVRHEETLPRELKRHLNSLEEQLLESMAWEKGSSLYNSLIVARPSVASEINRLGLLAEPMPSLD

SEQ ID NO: 2349 - protein, 276 aa, Solanum lycopersicum
LQFELAKAMSPCIIWIPNIHDLDVNESNDLSLGLLVNHLSRDCERCSTRNILVIASTHIPQKVDPALIAPNKLNTCIKIRRLLIPQQRKHFFTLSYTRGFHLEKKMFHTNGFGSITMGSNARDLVALTNEVLSISITQKKSIIDTNTIRSALHRQTWDLRSQVRSVQDHGILFYQIGRAVAQNVLLSNCPIDPISIYMKKKSCNEGDSYLYKWYFELGTSMKRLTILLYLLSCSAGSVAQDLWSLSVPDEKNGITSYGLVENDSDLVHGLLEVEGA

SEQ ID NO: 2350 - protein, 126 aa, Solanum lycopersicum
TLMFCLANQGDAFLLPTPYYPGFDRDLKWRTGAEIVPIHCSSSNGFRITESALEEAYLDAKKRNLKVKGVLVTNPSNPLGTTLNRNELELLLTFIDEKGIHLISDEIYSGTVFNSPGFVSVMEVLI

SEQ ID NO: 2351 - protein, 176 aa, Solanum lycopersicum
EGLLQAQQFPSTAAVSHLDKKLETLPELIAGVWSDDSSLQLECTTQFRKLLSIERNPPIEEVIQSGVVPRFVEFLARDDYPQLQFEAAWALTNIASGTSENTKVVIDYGSVPIFIRLLSSPSDDVREQAVWALGNIAGDSPKYRDLVLGHGALVALLAQFNEQAKLSMLRNATWTL

SEQ ID NO: 2352 - protein, 176 aa, Oryza sativa
LLKSDELEVQIHAVKVVANLAAEDVNQEKIVEEGGLDALLSLLETSENTTIHRVTAGAIANLAMNGSNQGLIMNKGGARLLANIASKTNDPQTLRMVAGALANLCGNEKLHVMLKQDGGIKALLGMFRTGHNEVIAQIARGMANFAKCESRVISQGHRKGRSLLIEEGVLNWMVAN

SEQ ID NO: 2353 - protein, 176 aa, Zea mays
MKKATSLSELGFDAGDASSGFFRPVSGDSSTPTSQHHRRRLTKVSVIGAGNVGMAIAQTILTRDLADEIALVDAVPDKLRGEMLDLQHAAAFLPRTRLVSGTDMSVTRGSDLVIVTAGARQIQGETRLDLLQRNVALFRKIVPPLAEQSHDALLLVVSNPVDVLTYVAWKLSGFPA

SEQ ID NO: 2354 - protein, 101 aa, Oryza sativa
SESVSWILKVRSVHGFQPATAYLAVSYMDRFMSSRSLPDHGWASQLLCVACLSLAAKMEESSAPPLLDLQIEGTRFIFEPRTIQRMELIVLVELDWRLRSV

SEQ ID NO: 2355 - protein, 151 aa, Oryza sativa
NGCTDFEYPRYADLINLLKLVSDDGYLTSQTCSEKLKCLAVQIIAKIGSRQNAECDLQVLELAIQSETGELQNEALMSLPIIVLYSGPRMLGAMFRKLETIGTLGCKKLWKSIAISLGFLSCLNGTTDCTDKVGNHCKLFLAKHCEQPILT

SEQ ID NO: 2356 - protein, 101 aa, Oryza sativa
AGVVAALRSAKLGGAAVGVVITASHNPVRDNGVKIVDADGGMLSQDWEPFADALANAPNPDALLQIVLQFAKDEDIKLGGSHSAQVLLARDTRPTGEYLLD

SEQ ID NO: 2357 - protein, 226 aa, Oryza sativa
MTGGSGVVVLDNGGGLLKAGFGGDMNPTAVVPNCMAKPPGSKKWLVADQLQAQDVDVTGMTLRRPIDRGYLINQEVQREVWERVIRNLLQVDPNNSSLLLVEPQFNPPALQHATDELVFEELGFKSLCVADAPSLVHLYEASRQPSLFRAQCSLVVDCGFSFTHASPVLQNFTLNYAVRRMDLGGKALTNYLKELISYRSLNVMDETLLIDDAKEKLCFVSLDVPG

SEQ ID NO: 2358 - protein, 126 aa, Zea mays
PLTPDNVVVFPSRSVAIENALQLFSPALAIVDEHLTRHLPKQWLTSLAIEGRADCNHADGTVTVIEAPRQSDLLIELIRKLQPQVVVTGMAQFEAITSAAFENLLNVTKDVGSRLFLDISEHLELS

SEQ ID NO: 2359 - protein, 276 aa, Solanum lycopersicum
EGLLQAQQFPSTAAVSHLDKKLETLPELIAGVWSDDSSLQLECTTQFRKLLSIERNPPIEEVIQSGVVPRFVEFLARDDYPQLQFEAAWALTNIASGTSENTKVVIDYGSVPIFIRLLSSPSDDVREQAVWALGNIAGDSPKYRDLVLGHGALVALLAQFNEQAKLSMLRNATWTLSNFCRGKPQPLFEQTKAALPTLGRLIHSNDEEVLTDACWALSYLSDGTNDKIQAVIEAGVCSRLVELLLHSSPSVLIPALRTVGNIVTGDDIQTQVMIDH

SEQ ID NO: 2360 - protein, 201 aa, Oryza sativa
QIDTVVVSSPAAAQEVLRDKDVMFASRPSLLVSEIFCYDNLDVGFAPYGAYWRMLRKLCTVELLSTKVVRQLAPVRNDETLTLVRNIKAASSGHGGGGGKKPVTLARLLTTCTNTITAKAAFGQACGVELQEQFLTALDVGLKFSGGFCFGDLFPSLRFIDAMTGLRSRLWRARGQLDSVFDKIIAQCEEHQGDSLVNVLL

SEQ ID NO: 2361 - protein, 276 aa, Zea mays
FGYSSEDVQMVIESMASQGKEPTFCMGDDIPLAVLSQRPHLLYDYFKQRFAQVTNPAIDPLREGLVMSLEVNIGKRGNILEVGPENADQVALSSPVLNEGELETLLNDSKLKPKVLSTYFDIRKGLDGSLDKTIQALCEEADAAVRSGSQLLVLSDRSEAPEPTRPAIPILLAVGAIHQHLIQNGLRMSASIVADTAQCFSTHHFACLIGYGASAVCPYLALETCRQWRLSNKTLNLMRNGKMPTVTIEQAQRNFIKAVKSGLLKILSKMGISLLS

SEQ ID NO: 2362 - protein, 101 aa, Zea mays
MAPLKLYGMPLSPNVVRVATVLNEKGLDFEIVPVDLTTGAHKQPDFLALNPFGQIPALVDGDEVLFESRAINRYIASKYASEGTDLLPATASAAKLEVWLE

SEQ ID NO: 2363 - protein, 226 aa, Solanum lycopersicum
FYQQFACVGGDPVFSESLCKELQKKFFQQRCELGRIGRRNMNRKLNLDIPQNNTFLLPRDILAAADHLIGLKFGMGALDDMNHLKNKRIRSVADLLQDQFGLALVRLENVVRGTICGAIRHKLIPTPQNLVTSPPLTTTYESFFGLHPLSQVLDRTNPLTQIVHGRKLSYLGPGGLTGRTASFRIRDIHPSHYGRICPIDTSEGINVGLIGSLSIHARIGHWGSLE

SEQ ID NO: 2364 - protein, 101 aa, Oryza sativa
RQPLSRKVPISSSRINPYRMVIVLRLIVLCIFLHYRITNPVRNAYPLWLLSVICEIWFALSWILDQFPKWSPINRETYLDRLALRYDREGEPSQLAPVDIF

SEQ ID NO: 2365 - protein, 251 aa, Zea mays
WAYMKSGGHISHALSVYSCQLRQPNQVKKIFEFLKDGFHEVSSSLDLSFDDDSVAEEKIPFLAYLASFLKENKSNPCEPPAGCLNFRKLVAGFMKSYHHIPLTPDNVVVFPSRSVAIENALQLFSPALAIVDEHLTRHLPKQWLTSLAIEGRADCNHADGTVTVIEAPRQSDLLIELIRKLQPQVVVTGMAQFEAITSAAFENLLNVTKDVGSRLFLDISEHLELSSLPSSNGVLKYLAGKTLPSHAAILC

SEQ ID NO: 2366 - protein, 151 aa, Zea mays
GKTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKAS

SEQ ID NO: 2367 - protein, 226 aa, Oryza sativa
AIAELQQTLLNMPADVLGPTVLSSLSSLSLALPNAPLSVTQASKENPDVSKTLLLYTRWIHYTGQKQSNDIKSLYSRVADLRPKWEKGFFCIAKFYDDLLVDARRRQEDKKIASGVGPVPPSSTGSLTTATEEKPWWDMLPVVLIQYARGLHRGHKNLFQALPRLLTLWFEFGSIYIQDGSSFNKPMKEVHIRLLGIMRGCLKDLPPYQWLTVLSQLISRICHQNI

SEQ ID NO: 2368 - protein, 176 aa, Zea mays
EHSVCFAVPEKEVALVSAALHARFREALAAGRLSKVEVIHNCSILATVGLRMASTPGVSATLFDALAKANINVRAIAQGCSEYNITIVLKQEDCVRALRAAHSRFFLSKTTLAVGIIGPGLIGRTLLNQLKDQAAVLKENMNIDLRVMGIAGSRTMLLSDIGVDLTQWKEKLQTEA

SEQ ID NO: 2369 - protein, 76 aa, Oryza sativa
RVRMDAIDWIWKVHSYYSFAPLTACLAVNYLDRFLSLYQLPDGKDWMTQLLAVACLSLAAKMEETDVPQSLDLQVG

SEQ ID NO: 2370 - protein, 76 aa, Oryza sativa
IGTVRRELYLWESVARSARKALGLRYRLLPYLYTLMYEAHTTGAPIARPLFFSYPGDVETYGIDRQFLLGRGVLVS

SEQ ID NO: 2371 - protein, 176 aa, Solanum lycopersicum
KGKIHEVLKNWPEKKIQVIVVTDGERILGLGDLGCQGMGIPVGKLSLYSALGGIRPSACLPVTIDVGQTMKFVDDEFYIGLRQRRATGQEYSELLDEFMYAVKQNYGEKVLIQFEDFANHNAFNLLAKYGTSHLVFNDDIQGTASVVLAGLMAALNLVGGSLSEHTFLFLGAGEAG

SEQ ID NO: 2372 - protein, 126 aa, Oryza sativa
MAVVHRILRRGLSAASPLPSLRGLLLVSPQELGRRPASSSSSAAAAAGDVEAELRAAREDVRQLLKSNPCHPILVRLGWHDAGTYDKNITEWPKCGGANGSLRFGVELVHAANKGLLKALFLVIPI

SEQ ID NO: 2373 - protein, 76 aa, Zea mays
LWADARKMEASKLYYRVLEAICRAELQNSNVNNLTPLLSNERFHRCLIACSADVVLATHKTVIMMFPAVLESAGLT

SEQ ID NO: 2374 - protein, 126 aa, Oryza sativa
ALSLAVLSLGAVLSAANPLLTPDELARQADDAKPFLALVTGELAPKLRSIAPDVKLVLVEQLLADVAAEVDDDETLDLPAANIGRDDAALLFYSSGTTGRSKGVVSTHGNAIAMAASLERAWGGGG

SEQ ID NO: 2375 - protein, 76 aa, Zea mays
IPWAEARKVEASKLYYRVLEAICRAELQNSNVNNLTPLLSNERFHRCLIACSADLVLATHKTVIMMFPAVLESTGL

SEQ ID NO: 2376 - protein, 176 aa, Zea mays
ELETLLNDSKLKPKVLSTYFDIRKGLDGSLDKTIQALCEEADAAVRSGSQLLVLSDRSEAPEPTRPAIPILLAVGAIHQHLIQNGLRMSASIVADTAQCFSTHHFACLIGYGASAVCPYLALETCRQWRLSNKTLNLMRNGKMPTVTIEQAQRNFIKAVKSGLLKILSKMGISLLS

SEQ ID NO: 2377 - protein, 76 aa, Oryza sativa
EQHEVVDGNESFPMALYVVSGDEDGERGGAPVVCIDVAAQLCCDFNKGQSTWSPILLLVPLVLGLDKINPRYIPLL

SEQ ID NO: 2378 - protein, 101 aa, Oryza sativa
GLHYCHVNQVLHRDIKGSNLLIDNEGNLKLADFGLARSFSSDHNGNLTNRVITLWYRPPELLLGSTRYGPAVDMWSVGCIFAELLNGKPILTGKNEPEQLS

SEQ ID NO: 2379 - protein, 101 aa, Oryza sativa
GLHYCHINQVLHRDIKGSNLLIDNEGNLKLADFGLARSFSNDHNGNLTNRVITLWYRPPELLLGSTKYGPAVDMWSVGCIFAELLNGKPILPGKNEPEQLS

SEQ ID NO: 2380 - protein, 201 aa, Solanum lycopersicum
PVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLS

SEQ ID NO: 2381 - protein, 276 aa, Oryza sativa
MMEINSEATVTLVSVVTLPILLALLTRKSSSKKRRPPGPWNLPLVGGLLHLLRSQPQVALRDLAGKYGPVMFLRTGQVDTVVISSPAAAQEVLRDKDVTFASRPSLLVSEIFCYGNLDIGFAPYGAYWRMLRKLCTVELLSTKMVRQLAPIRDGETLALVRNIEAAAGGKKPFTLATLLISCTNTFTAKAAFGQACGGELQEQFLTALDEALKFSNGFCFGDLFPSLRFIDAMTGLRSRLERLRLQLDTVFDKIVAQCESNPGDSLVNVLLRIKDQ

SEQ ID NO: 2382 - protein, 76 aa, Zea mays
MWFGGGPIDAAGALRGFVREAGGCAVVDGGLGTELEAHGADLHDALWSAKCLASAPHLIRKVHLDYLEAGADVIIS

SEQ ID NO: 2383 - protein, 76 aa, Solanum lycopersicum
MSSLVLQCWKLSSPSLILQQNTSISMGAFKGIHKLQIPNSPLTVSARGLNKISCSLNLQTEKLCYEDNDNDLDEEL

SEQ ID NO: 2384 - protein, 176 aa, Oryza sativa
FTDIESYLRLAHELDMLVMLRVGPYICGEWDLGGFPPWLLTIEPTIELRSSDSTYLSLVDRWWGVLLPKIAPLLYSNGGPIIMVQIENEFGSFGDDKNYLHYLVEVARRYLGNDIMLYTTDGGAIGNLKNGTILQDDVFAAVDFDTGSNPWPIFQLQKEYNLPGKSAPLSSEFYTG

SEQ ID NO: 2385 - protein, 76 aa, Solanum lycopersicum
LQFELAKAMSPCIIWIPNIHDLDVNESNDLSLGLLVNHLSRDCERCSTRNILVIASTHIPQKVDPALIAPNKLNTC

SEQ ID NO: 2386 - protein, 126 aa, Oryza sativa
MATARVSLILLVVVLAASACAEGLRLPRDAKFPAAQAERLIRSLNLLPKEAGPTGAGDVPSVAPGELLERRVTLPGLPQGVGDLGHHAGYYRLPNTHDARMFYFLFESRGKKEDPVVIWLTGGPGC

SEQ ID NO: 2387 - protein, 201 aa, Solanum lycopersicum
MEEIHRYLQPDSSQQHNFLYPLIFQEYIYALAQDHGLNRNRSILLENSGYNNKFSFLIVKRLITRMDQQNHLIISTNDSNKNPFLGCNKSLYSQMISEGFACIVEIPFSIRLISSLSSFEGKKIFKSHNLRSIHSTFPFLEDNFSHLNYVLDILIPYPVHLEILVQTLRYWVKDASSLHLLRFFLHEYCNLNSLITSKKPG

SEQ ID NO: 2388 - protein, 276 aa, Zea mays
MALGAAYHHYLQLAGDHGTATHALLLGVLIFLVIRLVSARRTGTTSANKRKQQQRLPLPPWPPGKLPIIGHLHLIGAETHISIRDLDAKHGRNGLLLLRIGAVPTLFVSSPSAADAVLRTQDHIFASRPPWMAAEIIRYGPSDVAFVPYGEYGRQGRKLLTTHMLSTKKVQSFRHGRQEEVRLVMDKIRAAATAAPPAAVDLSDLLSGYTNDVVSRAVLGASHRNQGRNRLFSELTEINVSLLAGFNLEDYFPPNMAMADVLLRLVSVKARRLNQR

SEQ ID NO: 2389 - protein, 226 aa, Oryza sativa
ALSLAVLSLGAVLSAANPLLTPDELARQADDAKPFLALVTGELAPKLRSIAPDVKLVLVEQLLADVAAEVDDDETLDLPAANIGRDDAALLFYSSGTTGRSKGVVSTHGNAIAMAASLERAWGGGGGGGEKPQQYDDHDEAYGCVLPMFHMFGFSSFVMGTAALGATAVVVPGRFSVEKTMAAVEEYGVTRLLVVPPMVVKMVAAAAGDGEPSRRRLRLRQVVSSG

SEQ ID NO: 2390 - protein, 226 aa, Zea mays
EYIYAFAHDYGLNGSEPVEIFGCNNKKFSSLLVNRLIIRMYQQNFLINSVNYPNQDRLLDHRNYFYSEFYSQILSEGFAIVVEIPLSLGQLSCPEEKEIPNFQNLQSIHSIFPFLEDKFLHLHYLSHIKIPYPIHLEILVQLLEYRSQDVPSLHLLRFFLYYYSNWNSFITSMKSIFLLKKENKRLFRFLYNSYVSEYEFFLLFLHKQSSCLRLTSSGTFLERIIF

SEQ ID NO: 2391 - protein, 76 aa, Oryza sativa
LKPENLLVSKDVIKLADFGLAREVTSVPPYTEYVSTRWYRAPEVLLQSSIYDSAVDMWAMGAIMAELLTLHPLFPG

SEQ ID NO: 2392 - protein, 126 aa, Oryza sativa
MAPPESSHHHLLESGLLEVSKAPSAAVAAEEEEKKEAAAWTPSSSSSMTGRKIKSEASPLLRRLLGGPAAQLQEVLLGTKLYPLFSAVPLAVAAESLRLGRVWVFAFSLIGLAPLAERVSFLSEHI

SEQ ID NO: 2393 - protein, 101 aa, Zea mays
DKYDLYGSVAFPKHHNQADVPEIYRLAAKMKGVFINPALVEPFGLTLIEAAAHGLPIVATKNGGPVDITNALNNGLLVDPHDQNAIADALLKLVADKNLWQ

SEQ ID NO: 2394 - protein, 151 aa, Oryza sativa
DHDIPEPLSSRLSVPSGELNLYRAAVALRLVLLAAFFRYRVTRPVADAHALWVTSVACELWLAASWLIAQLPKLSPANRVTYLDRLASRYEKGGEASRLAGVDVFVAAADAAREPPLATANTVLSVLAADYPAGGVACYVHDDGADMLVFE

SEQ ID NO: 2395 - protein, 226 aa, Solanum lycopersicum
GMWSLRSATDDPYDTFLVVSFISETRVLAMNLEDELEETEIEGFNSQVQTLFCHDAVYNQLVQVTSNSVRLVSSTSRDLKNEWFAPVGYSVNVATANATQVLLATGGGHLVYLEIGDGVLNEVKYAKLDYDISCLDINPIGENPNYSNIAAVGMWTDISVRIYSLPDLNLITKEQLGGEIIPRSVLMCSFEGISYLLCALGDGHLLNFVLSMSTGELTDRKKVSLG

SEQ ID NO: 2396 - protein, 201 aa, Solanum lycopersicum
VLLATGGGHLVYLEIGDGVLNEVKYAKLDYDISCLDINPIGENPNYSNIAAVGMWTDISVRIYSLPDLNLITKEQLGGEIIPRSVLMCSFEGISYLLCALGDGHLLNFVLSMSTGELTDRKKVSLGTQPITLRTFSSKDTTHVFAASDRPTVIYSSNKKLLYSNVNLKEVSHMCPFNVAAFPDSLAIAKEGELTIGTIDEI

SEQ ID NO: 2397 - protein, 76 aa, Solanum lycopersicum
LPGWFSEISPLWPGEAHSLKVEKILFQGKSDYQNVLVFQSSTYGKVLVLDGVIQLTERDECAYQEMITHLPLCSIP

SEQ ID NO: 2398 - protein, 176 aa, Solanum lycopersicum
NTKVVIDYGSVPIFIRLLSSPSDDVREQAVWALGNIAGDSPKYRDLVLGHGALVALLAQFNEQAKLSMLRNATWTLSNFCRGKPQPLFEQTKAALPTLGRLIHSNDEEVLTDACWALSYLSDGTNDKIQAVIEAGVCSRLVELLLHSSPSVLIPALRTVGNIVTGDDIQTQVMIDH

SEQ ID NO: 2399 - protein, 226 aa, Zea mays
PLTPDNVVVFPSRSVAIENALQLFSPALAIVDEHLTRHLPKQWLTSLAIEGRADCNHADGTVTVIEAPRQSDLLIELIRKLQPQVVVTGMAQFEAITSAAFENLLNVTKDVGSRLFLDISEHLELSSLPSSNGVLKYLAGKTLPSHAAILCGLVKNQVYSDLEVAFAISEDAAVYKALSQTIELLEGHTSLISQHYYGCLFHELLAFQIADRHPQQERQPAEVIPQ

SEQ ID NO: 2400 - protein, 76 aa, Oryza sativa
LCAVRAGAAVALMPRFEMGAMLGAIERWRVTVAAVVPPLVLALAKNPFVERHDLSSIRIVLSGAAPLGKELEDALR

SEQ ID NO: 2401 - protein, 151 aa, Zea mays
PVDASQPLAEQGPFHLLIHKLYGDDWRAQLVAFAARHPAVPIVDPPHAIDRLHNRISMLQVVSELDHAADQDSTFGIPSQVVVYDAAALADFGLLAALRFPLIAKPLVADGTAKSHKMSLVYHREGLGKLRPPLVLQEFVNHGGVIFKVYV

SEQ ID NO: 2402 - protein, 101 aa, Oryza sativa
AIAELQQTLLNMPADVLGPTVLSSLSSLSLALPNAPLSVTQASKENPDVSKTLLLYTRWIHYTGQKQSNDIKSLYSRVADLRPKWEKGFFCIAKFYDDLLV

SEQ ID NO: 2403 - protein, 251 aa, Zea mays
SYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNVMVSSYARTKEASQAKYISILNIIQGEVDPTQVHESLQRIRERKLVNFIDWAPASIQVALSRKSPYVQTTHRVSGLMLANHTSIRHLFGKCLGQYEKLR

SEQ ID NO: 2404 - protein, 201 aa, Oryza sativa
GYPQSMLDILGRNNIAAVQGPLHRAMRGAMLSLVRPAMIRSSLLPKIDAFMRSHLAAWSSSSSSAVVDIQAKTKEMALLSALRQIAGVSAGPLSDALKAELYTLVLGTISLPINLPGTNYYQGFKARKKLVAMLEQMIAERRSSGQVHDDMLDALLTGVEGTREKLTDEQIIDLIITLIYSGYETMSTTSMMAVKYLSDHP

SEQ ID NO: 2405 - protein, 76 aa, Oryza sativa
LDGTKLVVSGGCADSGVLLSDTYLLDVTMDKPVWREVPASWTPPSRLGHSMSVYGGRKILMFGGLAKSGPLRLRSS

SEQ ID NO: 2406 - protein, 176 aa, Oryza sativa
MMEINSEATVTLVSVVTLPILLALLTRKSSSKKRRPPGPWNLPLVGGLLHLLRSQPQVALRDLAGKYGPVMFLRTGQVDTVVISSPAAAQEVLRDKDVTFASRPSLLVSEIFCYGNLDIGFAPYGAYWRMLRKLCTVELLSTKMVRQLAPIRDGETLALVRNIEAAAGGKKPFTLA

SEQ ID NO: 2407 - protein, 126 aa, Solanum lycopersicum
NTTGLPTIDYRITDAMADPPNAKQKHVEELVRLPNSFLCYTPSPEAGPVCPAPALSNGFVTFGSFNNLAKITPKVLKVWARILSAVPHSRLIVKCKPFCCDSVRQRFLSILEQLGLEPQRVDLLPL

SEQ ID NO: 2408 - protein, 276 aa, Solanum lycopersicum
NTKVVIDYGSVPIFIRLLSSPSDDVREQAVWALGNIAGDSPKYRDLVLGHGALVALLAQFNEQAKLSMLRNATWTLSNFCRGKPQPLFEQTKAALPTLGRLIHSNDEEVLTDACWALSYLSDGTNDKIQAVIEAGVCSRLVELLLHSSPSVLIPALRTVGNIVTGDDIQTQVMIDHHALPCLVNLLTQNYKKSIKKEACWTISNITAGNRNQIQIVIEAGIIAPLVYLLQNAEFEIKKEAAWAISNATSGGNHDQIKFLVSQGCIKPLCDLLVCPD

SEQ ID NO: 2409 - protein, 76 aa, Oryza sativa
GGCGRQGLLNDVFMLDLDAQQPTWREIPGLAPPVPRSWHSSCTLDGTKLVVSGGCADSGVLLSDTYLLDVTMERPV

SEQ ID NO: 2410 - protein, 151 aa, Oryza sativa
MGELADLVVVPSQPPLAGGRRDRLAALLELAAADDVDGLRGALAEGGEEAAELADGVGLWYGRSKAYEARTPLMVAATYGSAGVVSLLVGLGGCVDVNRRPGADGATALHCAASGGSRNAVAVVKLLLAAGADPATPDSAGRFPADVILAP

SEQ ID NO: 2411 - protein, 76 aa, Solanum lycopersicum
NTKVVIDYGSVPIFIRLLSSPSDDVREQAVWALGNIAGDSPKYRDLVLGHGALVALLAQFNEQAKLSMLRNATWTL

SEQ ID NO: 2412 - protein, 151 aa, Oryza sativa
AGSWVGPYAMCRAWQTLVCTNREHHEAVDGNGNFPMALYVVSGDEDGERGGAPVVCIDVAAQLCCDFNKNQSTWSPILLLVPLVLGLDKLNPRYIPLLKETLTFPQSLGILGGKPGTSTYIAGVQDDRALYLDPHEVQLAVDIAADNLEAG

SEQ ID NO: 2413 - protein, 176 aa, Oryza sativa
ITIDDDEATPEGCLPFWDLIADADEGSVPEVAISPDDPVALPFSSGTTGLPKGVVLTHRSVVSGVAQQVDGENPNLHMGAGDVALCVLPLFHIFSLNSVLLCAVRAGAAVALMPRFEMGAMLGAIERWRVTVAAVVPPLVLALAKNPFVERHDLSSIRIVLSGAAPLGKELEDALR

SEQ ID NO: 2414 - protein, 101 aa, Solanum lycopersicum
LLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEG

SEQ ID NO: 2415 - protein, 101 aa, Zea mays
LEVEAHQLSPPAIAIVVECVFAPFLGRERNQAVVDENVEKLKKVLEVYEARLATCTYLAGDFLSLADLSPFTIMHCLMATEYAALVHALPHVSAWWQGLAA

SEQ ID NO: 2416 - protein, 176 aa, Oryza sativa
LINCLSPDNHMAYPLEPAISIQVLSLLCLSLSVYPKTNLFSRISKQVLSWIPWICKQTTKICMFSFDVSLYFEAVQTVMLLQSFLPGHTKLFEDEPLLIGNGCTDFEYPRYADLINLLKLVSDDGYLTSQTCSEKLKCLAVQIIAKIGSRQNAECDLQVLELAIQSETGELQNEAL

SEQ ID NO: 2417 - protein, 176 aa, Zea mays
VCFAVPEKEVAVVSAELHDRFREALAAGRLSKVEVINGCSILAAVGLRMASTPGVSAILFDALAKANINVRAIAQGCSEYNITVVLKQQDCVRALRAAHSRFFLSKTTLAVGIIGPGLIGGALLNQLKNQTAVLKENMNIDLRVIGITGSSTMLLSDTGIDLTQWKQLLQKEAEPA

SEQ ID NO: 2418 - protein, 226 aa, Solanum lycopersicum
NTTGLPTIDYRITDAMADPPNAKQKHVEELVRLPNSFLCYTPSPEAGPVCPAPALSNGFVTFGSFNNLAKITPKVLKVWARILSAVPHSRLIVKCKPFCCDSVRQRFLSILEQLGLEPQRVDLLPLILLNHDHMQAYSLMDISLDTFPYAGTTTTCESLYMGVPCVTMGGSVHAHNVGVSLLKTVGLENLVARNEDEYVESAIQLASDVTSLSNLRMSLRELMSKS

SEQ ID NO: 2419 - protein, 126 aa, Zea mays
RVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYAN

SEQ ID NO: 2420 - protein, 76 aa, Zea mays
GTDMSVTRGSDLVIVTAGARQIQGETRLDLLQRNVALFRKIVPPLAEQSHDALLLVVSNPVDVLTYVAWKLSGFPA

SEQ ID NO: 2421 - protein, 101 aa, Oryza sativa
RVNDQYLLNLLLKINAKLGGINSLLQIEASPSIPLVSKTPTIILGMDVSHGQPGQSDRPSIAAVVSSRQWPLISKYRASVHTQSPKLEMMSSLFKPRGTED

SEQ ID NO: 2422 - protein, 126 aa, Solanum lycopersicum
GLQLNMELQLASQLSEKHVLRTQTLLCDMLLRDSPPGIVTQSPSIMDLVKCDGAALYYQRKYYPLGVTPTEAQIKDIVEWLLAYHGDSTGLSTDSLADAGYPGAASLGDAVCGMAVAYITSKDFLF

SEQ ID NO: 2423 - protein, 76 aa, Oryza sativa
PARRLVSRLLDPNPATRLAVAELATHPWFKRSLSLDSQLGSLLGGQPERELAFQAPPPLNAFDIISMSPGLDLSGL

SEQ ID NO: 2424 - protein, 101 aa, Oryza sativa
QCLAPTKINDQYLTNVLLKINAKLGGLNSLLQIERNQAIPLLSKTPTIILGMDVSHGSPGRDDVPSVAAVVSSLEWPLISKYKASVCTQSPRLEMIDSLFK

SEQ ID NO: 2425 - protein, 151 aa, Oryza sativa
MEELVYGFNLWDNILYLAVSYVDRFLSRNVVNRERLQLLGTSALFVASKYEDRCHPSARFFSSITADTYTTQQVVAMEANILSFLNFQMGSPTVITFLRRFLFSCRGSNRPINIRLELMCIYLAELSLLDDYNIRFLPSIVAAACLFVGKF

SEQ ID NO: 2426 - protein, 201 aa, Oryza sativa
RVSVLNDGSIVVEVGGVELGQGLWTKVQQMTAFALGQLWPKGCEGLLDRIRVLQSDTLNLIQGGLTAGSTTSESSCAATLQACNMLIERLKPVMERLQLQSDTVSWDTLISQASQENINLSASAYWVPEQDSNFYLNYGAGTSEVEVDLLTGAITIIRSDLIYDCGKSLNPAVDLGQIEGSFIQGIGFFIYEEHQTNSDGL

SEQ ID NO: 2427 - protein, 276 aa, Oryza sativa
MQFFAKQNCQVNLLTNNPSSNPRFIMEINSAATLTLVSLLTLPILLALLTRKSSSKKRRPPGPWNLPLVGGLLHLLRSHPQVALRELASKYGPVMFLRMGQIDTVVVSSPAAAQEVLRDKDVMFASRPSLLVSEIFCYDNLDVGFAPYGAYWRMLRKLCTVELLSTKVVRQLAPVRNDETLTLVRNIKAASSGHGGGGGKKPVTLARLLTTCTNTITAKAAFGQACGVELQEQFLTALDVGLKFSGGFCFGDLFPSLRFIDAMTGLRSRLWRARGQ

SEQ ID NO: 2428 - protein, 201 aa, Oryza sativa
QPPPTTPPPAPRRRDPRYAGVRRGDVRTLTAEKAAAAAAVPTAAQVHGSKSAASATTLRWSGMVSVAAIVLCFSSLVRSNSSLHDQVHHLKAQLAEATTKLQSCITESSMDMSSILSYQSNNSTSQNRGLKNFSLLLSLSTLYAPLLILKYMDLFLKLRSSQDSEEEVPINKRLAYRVDIFLSLQPYAKPLVLLVATLLLI

SEQ ID NO: 2429 - protein, 101 aa, Zea mays
GLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGG

SEQ ID NO: 2430 - protein, 201 aa, Oryza sativa
MVLVAIGVVVAAAVVVSSLLLRWNEVRYSRKRGLPPGTMGWPLFGETTEFLKQGPSFMKARRLRYGSVFRTHILGCPTVVCMEAELNRRALASEGRGFVPGYPQSMLDILGRNNIAAVQGPLHRAMRGAMLSLVRPAMIRSSLLPKIDAFMRSHLAAWSSSSSSAVVDIQAKTKEMALLSALRQIAGVSAGPLSDALKAEL

SEQ ID NO: 2431 - protein, 126 aa, Oryza sativa
LLPYLVLNVVCYGTPEARQSITEEILSVLNAAASESSGAIVHGITGGQSEVCIQAVFTLLDNLGQWVDDLKQEIALSQSNYAMAGRQGGKLRDESNSMYDQDQLLVQCSNVAELLAAIPKVTLAKA

SEQ ID NO: 2432 - protein, 76 aa, Oryza sativa
LKPENLLLDSHGALKVSDFGLSAFAPQTKEDGLLHTACGTPNYVAPEVLADKGYDGMAADVWSCGIILFVLMAGYL

SEQ ID NO: 2433 - protein, 276 aa, Oryza sativa
VVRINVPPGPFMARDPRVVALLDAKSFPVLFDVAKVEKRDVFTGTFMPSTSLTGGYRVCAYLDPSEPNHAKIKQLLLSLLVSRKDAFVPVFRSNFGALLDTVESQLASGGGKSDFTALNDATSFEFIGEAYFGVRPSASSSLGTGGPTKAALWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALE

SEQ ID NO: 2434 - protein, 76 aa, Solanum lycopersicum
RLYRERLLFLGQGIGTELSNQLIGLMLYLSMEDENKDLYLFVNSPGGWVIPGIAIYDTMQFVRPDIHTICLGLAAS

SEQ ID NO: 2435 - protein, 126 aa, Oryza sativa
GMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSIAASLWKLSSCDLCEIARNSVY

SEQ ID NO: 2436 - protein, 101 aa, Zea mays
VVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITID

SEQ ID NO: 2437 - protein, 76 aa, Oryza sativa
SIDPAARAESVSWILKVQEYNGFLPLTAYLAVNYMDRFLSLRHLPEGQGWAMQLLAVACLSLAAKMEETLVPSLLD

SEQ ID NO: 2438 - protein, 176 aa, Oryza sativa
MQFFAKQNCQVNLLTNNPSSNPRFIMEINSAATLTLVSLLTLPILLALLTRKSSSKKRRPPGPWNLPLVGGLLHLLRSHPQVALRELASKYGPVMFLRMGQIDTVVVSSPAAAQEVLRDKDVMFASRPSLLVSEIFCYDNLDVGFAPYGAYWRMLRKLCTVELLSTKVVRQLAPVR

SEQ ID NO: 2439 - protein, 101 aa, Solanum lycopersicum
VLLATGGGHLVYLEIGDGVLNEVKYAKLDYDISCLDINPIGENPNYSNIAAVGMWTDISVRIYSLPDLNLITKEQLGGEIIPRSVLMCSFEGISYLLCALG

SEQ ID NO: 2440 - protein, 201 aa, Oryza sativa
PATLLYSSGTTGPSKGVVATHRSLISMVQIIMTRFRLEGSDKTETFLCTVPMFHVYGLVAFATGLLGCGATVVVLSKYELPEMLRSINAYGVTYLPLVPPILVAMVAHPKPLPLGQMRKVLSGGAPLGKELIEGFREKYPQVEILQGYGLTESTAIGASTDSAEESRRYGTAGLLSPNTEAKIVDPDSGEALPVNRTGELW

SEQ ID NO: 2441 - protein, 226 aa, Oryza sativa
METELHLAAGYCAATGVYRSGHPPQFAAAAALSFPEYILPHMLLPGRRARPAFVDASTGAALSFAGLRALSLRVARALAAAGLRRGRVALLLSPNSLHFPALSLAVLSLGAVLSAANPLLTPDELARQADDAKPFLALVTGELAPKLRSIAPDVKLVLVEQLLADVAAEVDDDETLDLPAANIGRDDAALLFYSSGTTGRSKGVVSTHGNAIAMAASLERAWGGGG

SEQ ID NO: 2442 - protein, 76 aa, Oryza sativa
ILTGFKMHARGWISIYCMPPRPCFKGSAPINLSDRLNQVLRWALGSVEILLSRHCPIWYGYNGRLKLLERLAYINT

SEQ ID NO: 2443 - protein, 76 aa, Oryza sativa
FMGTVSAVQVADPIRWPNSPWRLLQVSWDEPDLLQNVKRVSPWLVELVSNMPAIHLAPFSPPRKKLCVPLYPELPI

SEQ ID NO: 2444 - protein, 151 aa, Oryza sativa
MRGAMKPSIVHCLKLLMLLALGGVTMHVPDEDDVVASLGALRLDGHFSFDDAHAAARDFGNRCSLLPAAVLHPGSVSDVAATVRRVFQLGRSSPLTVAARGHGHSLLGQSQAAGGIVVKMESLAAAAARAVRVHGGASPHVDAPGGELWIN

SEQ ID NO: 2445 - protein, 101 aa, Oryza sativa
MEAAAAMEAGRKLAARHPHGRSRTAHNMSSSSLRKKSDAALVRKVPVAPLRPLLANLQEVFLATKLAVLFPAVPLAIAAQCFRFDQVWVFALSLLGLIPLA

SEQ ID NO: 2446 - protein, 201 aa, Solanum lycopersicum
NLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKLSNIKTMVLSFNKFVGGLPDSFSNLL

SEQ ID NO: 2447 - protein, 251 aa, Oryza sativa
MEVAMVCTRVNLLILILSLCSPYKFIQSPMDFGPLNLLPTTTTASSDFGRILFHSPSAVLKPQAPRDISLLLSFLSASPLGKVTVAARGAGHSIHGQAQALDGIVVEMSSLPSEIEFYRRGEGDVSYADVGGGIMWIELLEQSLKLGLAPRSWTDYLYLTIGGTLSNAGISGQTFKHGPQISNVLQLEVVTGRGEIVTCSPTKDAELFNAVLGGLGQFGIITRARILLQEAPQKVKWVRAFYDDFATFTKD

SEQ ID NO: 2448 - protein, 101 aa, Oryza sativa
LPGQPKFLLCVLAERKNSDIYGPWKRKCLAEFGIITQCVAPTRVNDQYITNVLLKINAKLGGLNSLLQIETSPSIPLVSKVPTIILGMDVSHGSPGQSDIP

SEQ ID NO: 2449 - protein, 101 aa, Oryza sativa
MAAQRDDEAGWSAEAARRVWGGAVPLQVHLHDADVTTLPPPPPFLTLGPRIGYLPLLVPIIKAHFSSTLPPGIDTVWFEYKGLPLKWYIPIGVLYDLLCAD

SEQ ID NO: 2450 - protein, 176 aa, Oryza sativa
ARASPADVLAGASRRAVAAMGILLSRRHSPVWAGRRLGLLQRLGYVARASYPLASLPLTVYCALPAVCLLTGKSTFPSDVSYYDGVLLILLLFSVAASVALELRWSRVPLRAWWRDEKLWMVTATSASLAAVFQGILSACTGIDVAFSTETAASPPKRPAAGNDDGEEEAALASEI

SEQ ID NO: 2451 - protein, 176 aa, Oryza sativa
FIGEAYFGVRPSASSSLGTGGPTKAALWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALEKMELTRSVVWEALRLDPPVRFQYGR

SEQ ID NO: 2452 - protein, 76 aa, Solanum lycopersicum
MGITKKPDLNDPVLRAKLAKGMGHNYYGEPAWPNDLLYIFPVVILGTIACNVGLAVLEPSMIGEPADPFATPLEIL

SEQ ID NO: 2453 - protein, 76 aa, Zea mays
MGVTKKPDLNDPVLRAKLAKGMGHNYYGEPAWPNDLLYIFPVVILGTIACNVGLAVLEPSMIGEPADPFATPLEIL

SEQ ID NO: 2454 - protein, 276 aa, Oryza sativa
MDKSEMDKINGTNPESTDQAPSLASRPDEFEEEESLVTPDALSARIGGFQIYAGSVNWGVFGSMKIVFLKSKLNVLIPCGFLAIFLNYMTQRYGWVFPLSMLGIIPLAERLGFATDWQISCEVGRLLNSAFGNATELIISIHALSRGKLHVVQQCLLGSILSNLLLVLGSAFFSGGLACGKTMQTFSKADAVVNSGLLLMAVMGLLIPAALHYTHSEAQFGKSELALSRFSSCIMLVAYASYLYFQLSNNRRRNEANVYPCMPLIKRRIQDDVDGN

SEQ ID NO: 2455 - protein, 126 aa, Solanum lycopersicum
LGDSVHAMQPNLGQGGCMAIEDSYQLALELEKACSRSAEFGSPVDIISSLRSYESARKLRVGVIHGLARMAAIMASTYKAYLGVGLGPLSFLTQYRIPHPGRVGGRVFIDLGMPLMLSWVLGGNGD

SEQ ID NO: 2456 - protein, 76 aa, Zea mays
LKKEALWPYLQEFVDGALAHILNMSKALGEQVGNGRPVLPYVIHGHYADAGDVAALLSGALNVPMVLTGHSLGRNK

SEQ ID NO: 2457 - protein, 276 aa, Solanum lycopersicum
TSYLLPLSNLESLVLKNANLSGSLTSAAKSQCGVTLDSIDLAENTISGPISDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKL

SEQ ID NO: 2458 - protein, 176 aa, Oryza sativa
MELKAMYLYAAVLAVLLCSSVNFIQSPTDVLGPVALLEPTPSSARDFGAVVSDAPFAVMRPESPDDIALLLGALSSTAPSPRATVAAVGAGHSLHGQAQARDGIVVETRALPRDVHVVSARAHGGDDDATVRAYADVGAGALWVEVLEECLKLGLAPPSWTDYLYLTVGGTLSNGG

SEQ ID NO: 2459 - protein, 101 aa, Oryza sativa
GYPQSMLDILGRNNIAAVQGPLHRAMRGAMLSLVRPAMIRSSLLPKIDAFMRSHLAAWSSSSSSAVVDIQAKTKEMALLSALRQIAGVSAGPLSDALKAEL

SEQ ID NO: 2460 - protein, 76 aa, Solanum lycopersicum
VMGGTSGILYSIFCKAAYAKLKENAESVVTAIHWADALEAAIAAVSKYGGASAGYRTLLDALIPALSALKERLNAG

SEQ ID NO: 2461 - protein, 176 aa, Solanum lycopersicum
ILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGT

SEQ ID NO: 2462 - protein, 176 aa, Solanum lycopersicum
IGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKC

SEQ ID NO: 2463 - protein, 176 aa, Solanum lycopersicum
TSYLLPLSNLESLVLKNANLSGSLTSAAKSQCGVTLDSIDLAENTISGPISDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSS

SEQ ID NO: 2464 - protein, 176 aa, Oryza sativa
MDKSEMDKINGTNPESTDQAPSLASRPDEFEEEESLVTPDALSARIGGFQIYAGSVNWGVFGSMKIVFLKSKLNVLIPCGFLAIFLNYMTQRYGWVFPLSMLGIIPLAERLGFATDWQISCEVGRLLNSAFGNATELIISIHALSRGKLHVVQQCLLGSILSNLLLVLGSAFFSGG

SEQ ID NO: 2465 - protein, 101 aa, Solanum lycopersicum
FTGLFAKEEFVLQAYNSGKTQIIRPSGLILGGGWGLFGAQIVELLSIVVWVSLTMGPLFYLLQKLGILRISSDEEVAGLDISSHGGYAYDASQEESNARFY

SEQ ID NO: 2466 - protein, 101 aa, Solanum lycopersicum
CWKIFNSLNSLELKSLEEPIYLFGQFFKKPLECLTLAYYLPQNAGSIARKYIRDPGLLSFIDAECFIVSTVNALQTPMINASMVLCDRHFGGINYPVGGVG

SEQ ID NO: 2467 - protein, 126 aa, Oryza sativa
VVLFGGEGVNMQPMNDTFVLDLNASNPEWRHVNVSSAPPGRWGHTLSCLNGSLLVVFGGCGRQGLLNDVFTLDLDAKQPTWREIPGVAPPVPRSWHSSCTLDGTKLVVSGGCADSGVLLSDTYLLD

SEQ ID NO: 2468 - protein, 176 aa, Oryza sativa
MTARLALLASLLLLLQLVPPSSAVVLELHGNVYPIGHFFITMNIGDPAKSYFLDIDTGSTLTWLQCDAPCTNCNIVPHVLYKPTPKKLVTCADSLCTDLYTDLGKPKRCGSQKQCDYVIQYVDSSSMGVLVIDRFSLSASNGTNPTTIAFGCGYDQGKKNRNVPIPVDSILGLSRG

SEQ ID NO: 2469 - protein, 151 aa, Oryza sativa
MEVAMVCTRVNLLILILSLCSPYKFIQSPMDFGPLNLLPTTTTASSDFGRILFHSPSAVLKPQAPRDISLLLSFLSASPLGKVTVAARGAGHSIHGQAQALDGIVVEMSSLPSEIEFYRRGEGDVSYADVGGGIMWIELLEQSLKLGLAPR

SEQ ID NO: 2470 - protein, 76 aa, Zea mays
MLLWHGSRLTNFVGILSQGLRIAPPEAPVTGYMFGKGLYFADLVSKSAQYCYVDRNNPVGLMLLSEVALGDMYELK

SEQ ID NO: 2471 - protein, 151 aa, Oryza sativa
LQSCITESSMDMSSILSYQSNNSTSQNRGLKNFSLLLSLSTLYAPLLILKYMDLFLKLRSSQDSEEEVPINKRLAYRVDIFLSLQPYAKPLVLLVATLLLIGLGGLALYGVNDDSLLDCLWLSWTFVADSGNHANAEGFGPKLVSVSISIG

SEQ ID NO: 2472 - protein, 126 aa, Oryza sativa
AEPLTPLMVAAVYGSVGCLDALLSPPYLVDPNRASASSLSTPLHLAAAGGSASAPAAVSRLLAAGADPALLDHLQRRASDLVALPPNSLPLKNHLLSLLGARKEWPPDPSLPDIKNGAYASDDFRM

SEQ ID NO: 2473 - protein, 101 aa, Oryza sativa
ESLLDVVVSSLGTKLVRALTPGAPMEGVPSLRYIVASATPVPNSQSMLACHDMLYPYKVFFCHTPKQTRLYQVSLVSGESGRPLIDGLLAVCHQNTSDWDT

SEQ ID NO: 2474 - protein, 76 aa, Oryza sativa
KISDFGLSALPQHLGNDGLLHTTCGSPNYIAPEVLQNKGYDGSLSDIWSCGVILYVMLIGYLPFDDRNIVVLYQKI

SEQ ID NO: 2475 - protein, 101 aa, Oryza sativa
MAASRGPPLLGFRALALALLLAILLLLGCSAAAAYAGAEGVLRQVVGRRGDDGGGGNFFEPFNVTYDHRAVLIGGKRRMLVSAGLHYPRATPEMWPSLIAK

SEQ ID NO: 2476 - protein, 251 aa, Oryza sativa
MRPSLLQYLKLLLLLALGGVTTMHVPKQDVPSSLEELTLDGHFSFHDVSAAAQDFGNLSSFPPVAVLHPGSVADIATTIRHVFLMGEHSTLTVAARGHGHSLYGQSQAAEGIIISMESLQSNTMRVNPGVSPYVDASGGELWINVLHETLKYGLAPKSWTDYLHLTVGGTLSNAGVSGQTFRHGPQISNVNELEIVTGRGDVITCSPEQNSDLFHAALGGLGQFGVITRARIPLEPAPKMVRWLRVLYLDF

SEQ ID NO: 2477 - protein, 101 aa, Solanum lycopersicum
RTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQ

SEQ ID NO: 2478 - protein, 76 aa, Solanum lycopersicum
TIIIWIASALHAALHFGLYSYAGYLPNRPTLSCNLMPEPGSVEYEELKTNPDKVFLKTFVPQLQSLLEISIFEVSS

SEQ ID NO: 2479 - protein, 176 aa, Oryza sativa
MELPWLDLPFTLLTLLLATRLAYDYYGVVAATFTGSFSLQIFLFYCFARWYRHTIAARAAADADGDGGGGAVADEEAAPPVLIPLLEGRGGGGGGAGAASSLANRCFAVVFMVFVPLVIVVFERSQADVVAYALCLANILVMVVWLSPDAAADPASAAKSFLRLSDDEDEGSCSGS

SEQ ID NO: 2480 - protein, 76 aa, Oryza sativa
SRGNLKVSDFGLSTLAQKGVGLLHTTCGTPNYVAPEVLSNNGYDGSAADVWSCGVILYVLMAGYLPFEEDDLPTLY

SEQ ID NO: 2481 - protein, 176 aa, Oryza sativa
YKLPAWSVSILPDCKNVVLNTAQINSQVTTSEMRSLGSSIQDTDDSLITPELATAGWSYAIEPVGITKENALTKPGLMEQINTTADASDFLWYSTSIVVKGDEPYLNGSQSNLLVNSLGHVLQIYINGKLAGSAKGSASSSLISLQTPVTLVPGKNKIDLLSTTVGLSNYGAFFDL

SEQ ID NO: 2482 - protein, 201 aa, Zea mays
MAAAAAWTGAASPNSLLLSRSPPHAAALAPSPGSSMRRRLLLGVGTPAVAALAAAAPPAVLQDGAVTVLITAGAYSLVRVFDELTERRLIEKSLSRKVVHVLSGVLFMSSWPLFSNSTEARYFAAVVPFLNSMRLLIYGLRLYTDEALVKSVTREGKPEELLRGPLYYVLVLLFSVLVFWRESPIGIVSLSMMSGGDGFAD

SEQ ID NO: 2483 - protein, 76 aa, Oryza sativa
WHACAGPLVSLPPVGSLVVYFPQGHSEQVAASMHKELDNIPGYPSLPSKLICKLLSLTLHADSETDEVYAQMTLQP

SEQ ID NO: 2484 - protein, 76 aa, Oryza sativa
KILMFGGLAKSGPLRLRSNDVFTLDLSENKPCWRCITGSGMPGASNPAGVGPPPRLDHVAVSLPGGRILIFGGSVA

SEQ ID NO: 2485 - protein, 151 aa, Oryza sativa
MMGAEKAEGMEELELEEGGGSPSPSPMTAAGKMQALDFEHIGSLAAVAESLSTGSKWRRALTSVRVVILQAKINVLLPFGPLAVMLHYLSANHQGWVFLFSLIGITPLAERLGYATEQLALYTGPTIGGLLNATFGNATEMIISLYALKNG

SEQ ID NO: 2486 - protein, 176 aa, Oryza sativa
MLGIIPLAERLGFATDWQISCEVGRLLNSAFGNATELIISIHALSRGKLHVVQQCLLGSILSNLLLVLGSAFFSGGLACGKTMQTFSKADAVVNSGLLLMAVMGLLIPAALHYTHSEAQFGKSELALSRFSSCIMLVAYASYLYFQLSNNRRRNEANVYPCMPLIKRRIQDDVDGN

SEQ ID NO: 2487 - protein, 151 aa, Zea mays
MAAAARVSEVKAEGLLRGACTALAAAAALLVGLSTQTETVLLVRKKATVKDVQALWVLAMAAAAAAGYHLLQLLKCLYLGRVGGARPCRRSSRALAWTCLLLDKACAYTTFATTVAAAQACVVALDGAHALQWTKLCNIYTRFCEQVAGSL

SEQ ID NO: 2488 - protein, 176 aa, Oryza sativa
ATSLLVWLLLDSFVFGRLSVISAVQGMITGLVCVTPAARLVLHKRSRLLARVDDTLAVLHTHGVAGSLSGVLTGLLLLAEPRFARLFFGDDPRYVGLAYAVRDGRAGSGLRQVGVQLAGIAFVVALNVAVTSAVCLAVRVAVPQLAGGGDAIHGEDAYAVWGDGETYEQYSVHGGG

SEQ ID NO: 2489 - protein, 151 aa, Zea mays
MAAAARVSEVKAEGLLRGACAALAAAAALLVGLSTQTETVLLVRKKATVKDVQALWVLAMAAAAAAGYHLLQLLKCLYLGRVGGARPCRRSSRALAWTCLLLDKACAYTTFATTVAAAQACVVALDGAHAVQWTKLCNIYTRFCEQVAGSL

SEQ ID NO: 2490 - protein, 101 aa, Zea mays
MEVRGGVGQGSAARHPPAPEPSRAAARVQAGDALPLPIRHTNLIFSALFAASLAYLMRRWREKIRSSTPLHAVGLAEMLAIFGLVASLIYLLSFFGIAFVQ

SEQ ID NO: 2491 - protein, 126 aa, Oryza sativa
HSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGTIEPTSQSWGLSVSFISIILLPIVGN

SEQ ID NO: 2492 - protein, 226 aa, Oryza sativa
MAAEAAPEWVEKGDNAWPLAAATLVGLQSVPRLVILYGDCGAVGPRTEKDREAFPPNNVLLTLAGAGLLLWMGWTGFNGGAPYAANVDASVTVVNTHLCTATSLLVWLLLDSFVFGRLSVISAVQGMITGLVCVTPAARLVLHKRSRLLARVDDTLAVLHTHGVAGSLSGVLTGLLLLAEPRFARLFFGDDPRYVGLAYAVRDGRAGSGLRQVGVQLAGIAFVVAL

SEQ ID NO: 2493 - protein, 201 aa, Oryza sativa
AERVSFLTEQIALYTGPTVGGLLNATCGNATELIIALFALLKGKIEVVKCSLLGSVLSNLLLVLGTSLFCGGVVNLGARQPYDRNQSDVSTALLFLAVLCHSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGT

SEQ ID NO: 2494 - protein, 76 aa, Oryza sativa
MAGASSYFSLRRLLLLLLPLVPLLGATTAAAAGANSSVTYDHRSLIISGRRRLLISTSIHYPRSVPEMWPKLVAEA

SEQ ID NO: 2495 - protein, 151 aa, Zea mays
MAASVSASCLNRLSSLAVVLVALASAASAQLSSTFYDRSCPNALSTIRSGVNSAVRQEPRVGASLLRLHFHDCFVRGCDASLLLNDTSGEQSQGPNLTLNPRGFVVVNSIKAQVESVCPGIVSCADILAVAARDGVVALGGPSWTVLLGRR

SEQ ID NO: 2496 - protein, 76 aa, Oryza sativa
MENPQIEMGAFKANGPQLQNGGLRSSMVQSWNLQRFVESALRSIRIVIFTSKLNLLLPFGPASIILHYTTSRHGLV

SEQ ID NO: 2497 - protein, 101 aa, Zea mays
MAAAAAWTGAASPNSLLLSRSPPHAAALAPSPGSSMRRRLLLGVGTPAVAALAAAAPPAVLQDGAVTVLITAGAYSLVRVFDELTERRLIEKSLSRKVVHV

SEQ ID NO: 2498 - protein, 76 aa, Oryza sativa
SYADVGGGIMWIELLEQSLKLGLAPRSWTDYLYLTIGGTLSNAGISGQTFKHGPQISNVLQLEVVTGRGEIVTCSP

SEQ ID NO: 2499 - protein, 101 aa, Oryza sativa
RADVPLPADPEVDVVSFLASRRHSGVVALVDAATGRRITFTELWRAVAGAASALAAHPVSLRKGHVALILSPNSVHFPVAALAAMSLGAVLTTANPLNTPA

SEQ ID NO: 2500 - protein, 126 aa, Oryza sativa
FSLLSSSTLPGRPALVDAATGIAISYPSFLAAVRSLAGGLWCSLGLRPGDVALVVAPSRLEVPVLDFALMSIGAVVSPANPVSTPEEYAHQVALSRPVVAFAAPEVAAKLPEHVRCVVIGSDEYGR

SEQ ID NO: 2501 - protein, 276 aa, Oryza sativa
MENPQIEMGAFKANGPQLQNGGLRSSMVQSWNLQRFVESALRSIRIVIFTSKLNLLLPFGPASIILHYTTSRHGLVFLFSMLGITPLAERLGYATEQLAIYTGPTVGGLLNATFGNATEMIIAIYALKNGMIRVVQQSLLGSILSNMLLVMGCAFFAGGIVHRNKDQVFSKATAVVNSGLLLMAVMGLMFPAVLHFTHSEVRQGASEVSLSRFSSCIMLVAYASYLYFQLSGRNNAYSPIGSEEMPNEDAAEEDEESEIGMWESIAWLAMLTLWVS

SEQ ID NO: 2502 - protein, 126 aa, Zea mays
ESGASVVPGVAAAVAAVAERRELLLALRLATAVLSLAAFSVIASARTSGWAGDYYARHLQYRYAVAVNVIVFAYSVAQSLGKIRHLVSPRFTFRTMSSYYCSLFLDQVLAYLLMSASSAAASRNDL

SEQ ID NO: 2503 - protein, 276 aa, Oryza sativa
ARASPADVLAGASRRAVAAMGILLSRRHSPVWAGRRLGLLQRLGYVARASYPLASLPLTVYCALPAVCLLTGKSTFPSDVSYYDGVLLILLLFSVAASVALELRWSRVPLRAWWRDEKLWMVTATSASLAAVFQGILSACTGIDVAFSTETAASPPKRPAAGNDDGEEEAALASEITMRWTNLLVAPTSVVVANLAGVVAAVAYGVDHGYYQSWGALGAKLALAGWVVAHLQGFLRGLLAPRDRAPPTIAVLWSVVFVSVASLLWVHAASFSAPTA

SEQ ID NO: 2504 - protein, 76 aa, Zea mays
GALLLGFSAQTKTVLFIQKKAVPKDVQALWVLIVAAAAAAAYHVAQLARCFCMERLAITGGGGGCRRLGRAVACAS

SEQ ID NO: 2505 - protein, 101 aa, Oryza sativa
MCATLCTLLDEISILILMLLLIQLEIRVSAAQGGGSHAAMSPEQYWRSILPDSTPMPISISQLLGDGYPYSPAVGLPKRGDRVQIRYGPNIYGLAASQQFF

SEQ ID NO: 2506 - protein, 176 aa, Zea mays
MASSSFTSLSVMVLLCLAAAAVASAQLSPTFYSRSCPRALATIKAAVTAAVAQEARMGASLLRLHFHDCFVQGCDGSVLLNDTATFTGEQTANPNVGSIRGFGVVDNIKAQVEAVCPGVVSCADILAVAARDSVVALGGPSWRVLLGRRDSTTASLALANSDLPAPSLDLANLTAA

SEQ ID NO: 2507 - protein, 276 aa, Oryza sativa
FRSLRPPVPLPPPDVPLSFPEFAFSLLPRSSSSSSSSLLPANPALVDAATGEAVSFQAFLSRVRALAGALRSRVGLRGGDVAFVLAPAGLDVPVLYFALLSIGAVVSPANPALTPAEVSRLVSLSGASVAFAVSSTATKLPAGLTTVVLLDSPHFRSLLMDCGQAQGQEPLPVVVVRQSETAAIQYSSGTTGRVKAAALPHRSFIAMVAGFHALRAKAREVRTLLGAPMFHSMGFLFVLQGVALGATTVVVTDAVARAGIRGLVEAAERWAVMDMT

SEQ ID NO: 2508 - protein, 76 aa, Oryza sativa
ARASPADVLAGASRRAVAAMGILLSRRHSPVWAGRRLGLLQRLGYVARASYPLASLPLTVYCALPAVCLLTGKSTF

SEQ ID NO: 2509 - protein, 126 aa, Oryza sativa
MAAEAAPEWVEKGDNAWPLAAATLVGLQSVPRLVILYGDCGAVGPRTEKDREAFPPNNVLLTLAGAGLLLWMGWTGFNGGAPYAANVDASVTVVNTHLCTATSLLVWLLLDSFVFGRLSVISAVQG

SEQ ID NO: 2510 - protein, 76 aa, Zea mays
RSRAKYSRLLLVVLDAAMLALVTPGASAAAAIVYLAHKGNVRANWLAICQQFDSFCERISGCLIGSFGAMVMLVLL

SEQ ID NO: 2511 - protein, 151 aa, Zea mays
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGFLEKYPALVTGFFFFMWYFLNVIFNILNKKIYNYFPYPYFVSLIHLVVGVVYC

SEQ ID NO: 2512 - protein, 76 aa, Oryza sativa
MDRLLACLLGFLLIASVGSHAARTPEQYWKSALPNSPIPSSLSQLLSTAGGGTSVNVGGGGVHVDAGHGKPGGTTV

SEQ ID NO: 2513 - protein, 101 aa, Zea mays
MSPAPSRPRIRPWLVVGDLALAAAWVCAGALVKLLVYGGLGLGGRPEAEAVKVSLSLVYMFLFAWLEAASGGASYNPLTVLAAALASHGGPAVYLFTAFAR

SEQ ID NO: 2514 - protein, 101 aa, Oryza sativa
MQPYLQLASLRLATTIPLAPRLYDANLLAASGAAMASSMAYIALLCAALAAVVALLRWAYRWSHPRSNGRLPPGSLGLPVIGETLQFFAPNPTCDLSPFVK

SEQ ID NO: 2515 - protein, 101 aa, Solanum lycopersicum
GPSIAVISIFLSYSVIPFGDHLVLADLSIGVFFWIAISSIAPVGLLMSGYGSNNKYSFLGGLRAAAQSISYEIPLALCVLSISLLSNSLSTVDIVEAQSKY

SEQ ID NO: 2516 - protein, 76 aa, Oryza sativa
MDAFYSTSSAYGAAASGWGYDSLKNFRQISPAVQSHLKLVYLTLCVALAASAVGAYLHVALNIGGMLTMLGCVGSI

SEQ ID NO: 2517 - protein, 126 aa, Zea mays
MAMGATVRAAAADAVVTFLWVLCASALGASTAAVTSYLGVQEGAGHYALLVTTSLLSVLLFTFDLLCGALGGASFNPTDFAASYAAGLDSPSLFSVALRFPAQAAGAVGGALAISELMPAQYKHTL

SEQ ID NO: 2518 - protein, 76 aa, Oryza sativa
FIFFVVAYAVAAAYSLLVLAVPAGSALSRLALTTDVVLGMVLAGAVASAGAISDIAKNGNSHAGWLPVCGQIHAYC

SEQ ID NO: 2519 - protein, 100 aa, Gallus gallus
LQQIATDGSFAFTALDIRNLAALRELLLPNIVGVAQRLILLEAPTIVTEVIEVNKKDIVFLIDGSTALGTGPFNSIRDFVAKIVQRLEVGPDLIQVAVAQ

SEQ ID NO: 2520 - protein, 102 aa, Gallus gallus
IEEAVPQILVLISGGESSDDIREGLLAVKQASIFSFSIGVLNADSAELQQIATDGSFAFTALDIRNLAALRELLLPNIVGVAQRLILLEAPTIVTEVIEVNK

SEQ ID NO: 2521 - protein, 102 aa, Bos taurus-Gallus gallus-Bos taurus-Gallus gallus
ALTVIDFTEDEVEDLLSIVASVLHLTVLSDLIPEIEYVVSIASYDEVEESLALTVIDFTEDEVEDLLSIVASVLHLNEIILQVCSGVDEQLGELVSGEEVVE

SEQ ID NO: 2522 - protein, 100 aa, Gallus gallus
KVHKLQIEVENVTSLLNEAESKNIKLTKDVATLGSQLQDTQELLQEETRQKLNVTTKLRQLEDDKNSLQEQLDEEVEAKQNLERHISTLTIQLSDSKKKL

SEQ ID NO: 2523 - protein, 100 aa, Bos taurus
EEEEEARRSLEKQLQALQAQLTDTKKKVDDDLGTIENLEEAKKKLLKDVEVLSQRLEEKALAYDKLEKTKTRLQQELDDLLVDLDHQRQIVSNLEKKQKK

SEQ ID NO: 2524 - protein, 101 aa, Pisum sativum-Bos taurus-Bos taurus-Gallus gallus
IKTVTSLDLPVLRWLKLSAEHGSLHKDGKLVSIIAELLSTKTDMVEKALLYRQKLQLEKVTAEAKIKKMEEEILLLKVTTEAKLKKLEEDVIVLEDQNLKL

SEQ ID NO: 2525 - protein, 50 aa, Gallus gallus
AFTALDIRNLAALRELLLPNIVGVAQRLILLEAPTIVTEVIEVNKKDIVF

SEQ ID NO: 2526 - protein, 50 aa, Bos taurus
KLLILTCLVAVALARPKHPIKHQGLPQEVLNENLLRFFVAPFPEVFGKEK

SEQ ID NO: 2527 - protein, 50 aa, Bos taurus
LLILTCLVAVALARPKHPIKHQGLPQEVLNENLLRFFVAPFPEVFGKEKV

SEQ ID NO: 2528 - protein, 50 aa, Bos taurus
LILTCLVAVALARPKHPIKHQGLPQEVLNENLLRFFVAPFPEVFGKEKVN

SEQ ID NO: 2529 - protein, 50 aa, Bos taurus
ILTCLVAVALARPKHPIKHQGLPQEVLNENLLRFFVAPFPEVFGKEKVNE

SEQ ID NO: 2530 - protein, 50 aa, Bos taurus
LTCLVAVALARPKHPIKHQGLPQEVLNENLLRFFVAPFPEVFGKEKVNEL

SEQ ID NO: 2531 - protein, 50 aa, Bos taurus
SISSSEEIVPNSVEQKHIQKEDVPSERYLGYLEQLLRLKKYKVPQLEIVP

SEQ ID NO: 2532 - protein, 50 aa, Bos taurus
IVPNSVEQKHIQKEDVPSERYLGYLEQLLRLKKYKVPQLEIVPNSAEERL

SEQ ID NO: 2533 - protein, 90 aa, Phaseolus angularis
AADCNGACSPFQMPPCGSTDCLCIPAGLLFVGYCTYPSGLSSVAKMIDEHPNLCQSDDECMKKGSGNFCARYPNNYMDYGWCFDSDSEAL

SEQ ID NO: 2534 - protein, 322 aa, Gallus gallus
ADACSGLQGFLIFHSFGGGTGSGFTSLLMERLSVDYGKKSKLEFAIYPAPQVSTAVVEPYNSILTTHTTLEHSDCAFMVDNEAIYDICCRNLDIERPTYTNLNRLISQIVSSITASLRFDGALNVDLTEFQTNLVPYPRIHFPLVTYAPIISSERAYHEQLSVAEITSSCFEPNNQMVKCDPRHGKYMACCMLYRGDVVPKDVNVAIAAIKTKRNIQFVDWCPTGVKVGINYQPPTVVPGGDLAQVQRAVCMLSNTTAIAEAWARLDHKFDLMYAKRAFVHWYVSEGMEEGEFAEAREDLAALEKDYEEVGTDSFEDENDEE

SEQ ID NO: 2535 - protein, 50 aa, Bos taurus
LEYSREGLVWEDIDWIDNGECLDLIEKKLGLLALINEESHFPQATDSTLL

SEQ ID NO: 2536 - protein, 51 aa, Gallus gallus
LQQQFNMHVFKLEQEEYMKEQIPWTLIDFYDNQPCINLIEAKMGVLDLLDE

SEQ ID NO: 2537 - protein, 58 aa, Sus scrofa
LCINFANEHLQQFFVRHVFKLEQEEYDLESIDWLHIEFTDNQDALDMIANKPMNIISL

SEQ ID NO: 2538 - protein, 100 aa, Gallus gallus
NWIVDHVNKALHSTVKQHSFIGVLDIYGFETFEINSFEQFCINYANEKLQQQFNMHVFKLEQEEYMKEQIPWTLIDFYDNQPCINLIEAKMGVLDLLDEE

SEQ ID NO: 2539 - protein, 101 aa, Sus scrofa
EVKNPRRSIGLLDIFGFENFAVNSFEQLCINFANEHLQQFFVRHVFKLEQEEYDLESIDWLHIEFTDNQDALDMIANKPMNIISLIDEESKFPKGTDTTML

SEQ ID NO: 2540 - protein, 51 aa, Gallus gallus
LLGLLLAWLLLLGLLFGLIALAEEVRKLKSRVDNLEKINHSFLTVNQGNPY

SEQ ID NO: 2541 - protein, 53 aa, Saccharomyces cerevisiae
RPLLTLSSATRSVLFSLLASDMSIILSISPNTGILLCIGHLLASDIEDVVIVL

SEQ ID NO: 2542 - protein, 52 aa, Bos taurus
ILAAILHLGNLKFVVDGDTTLIEDGKLVSIIAELLSTKTDMVEKALLYRTVA

SEQ ID NO: 2543 - protein, 51 aa, Bos taurus
KLLKDVEVLSQRLEEKALAYDKLEKTKTRLQQELDDLLVDLDHQRQIVSNL

SEQ ID NO: 2544 - protein, 51 aa, Gallus gallus
LHLPFLFDSQWHKLMISVETTSVTLFIDCIKVETLNIKPKGKISVDGFSVL

SEQ ID NO: 2545 - protein, 52 aa, Saccharomyces cerevisiae
MIHGGVRYLEKAFWEFSKAQLDLVIEALNERKHLINTAPHLCTVLPILIPIY

SEQ ID NO: 2546 - protein, 52 aa, Saccharomyces cerevisiae
LIMKRNFLSWKRGLQLNYNVTRLEEWCKTHGLTDGTECLQHLIQTAKLLQVR

SEQ ID NO: 2547 - protein, 53 aa, Saccharomyces cerevisiae
LYLEEVSKNLVEINPLKLEVKAKPWFVYTPMHGVGFDIFSTIVKKTLCLVEGK

SEQ ID NO: 2548 - protein, 51 aa, Zea mays
EMLVNLGVPWVILGHSERRALLGESNEFVGDKVAYALSQGLKVIACVGETL

SEQ ID NO: 2549 - protein, 51 aa, Gallus gallus
GVDGSLQTASFLHLPFLFDSQWHKLMISVETTSVTLFIDCIKVETLNIKPK

SEQ ID NO: 2550 - protein, 103 aa, Bos taurus
LLWALAAALQRREPNLVSRLERHGVELKVAKAEVELSVKRLRAWGARVQAQGCALQVAELRGPVLRLREPLGVLAIVCPDEWPLLAFVSLLAPALAHGNTVVL

SEQ ID NO: 2551 - protein, 102 aa, Saccharomyces cerevisiae
LTLIYLNDLENETLKVFDKIYSTWLVKFMKHASAHIEIFDMVLNEKLFKNSGDEKFAKLFTFLNEFDAVLCKFQVVDSMHTKIFNDTLKYLNVMLFNDLITK

SEQ ID NO: 2552 - protein, 101 aa, Bos taurus
VLMRNVALPEDIRGKCTALLQLYDASNSEWQLGKTKVFLRESLEQKLEKRQEEEVTRAAMVIRAHVLGYLARKQYKKVLDCVVIIQKNYRAFLLRRRFLHL

SEQ ID NO: 2553 - protein, 101 aa, Ovis aries
WLLLCNPGLAELIAEKIGEDYVKDLSQLTKLNSFLGDDIFLREISNVKQENKLKFSQFLEKEYKVKINPSSMFDVQVKRIHEYKRQLLNCLHVVTMYNRIK

SEQ ID NO: 2554 - protein, 102 aa, Sus scrofa
LDTQKVAGTWHTVAMAVSDVSLLDAKSSPLKAYVEGLKPTPEGDLEILLQKRENDKCAQEVLLAKKTDIPAVFKINALDENQLFLLDTDYDSHLLLCMENSA

SEQ ID NO: 2555 - protein, 102 aa, Bos taurus
SLWAKVNVEVVGGESLARLLIVCPWTQRFFDSFGNLYSESAIMGNPKVKVYGRKVLNSFGNAIKHMDDLKGTFADLSELHCDKLHVDPENFRLLGNMILIVL

SEQ ID NO: 2556 - protein, 106 aa, Sus scrofa
LLNRLADLIERDRTYLAALETLDNGKPYVISYLVDLDMVLKCLRYYAGWADKYHGKTLPIDGDYFSYTRHEPVGVCGQIIPWNFPLLMQAWKLGPALATGNVVVMK

SEQ ID NO: 2557 - protein, 202 aa, Saccharomyces cerevisiae
QVKPKLVNVIRRESGNPDLLELLMDLNCYTLEVTEGYLKKVNVTEVNGDNVLGPIHVITTVVSSLVRNGLLIQSSKFISKVLLTVESIVMSLPKDETMLGGIFWLSNLSRLPAFAANQKTLYEANGGDEKDKLTLIYLNDLENETLKVFDKIYSTWLVKFMKHASAHIEIFDMVLNEKLFKNSGDEKFAKLFTFLNEFDAVL

SEQ ID NO: 2558 - protein, 202 aa, Oryza sativa
HVPRAVLMDLEPGTMDSLRSGPIGGIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPF

SEQ ID NO: 2559 - protein, 105 aa, Salmo trutta
RNQPTAALGHLLPEGTPVPLIPVLIIIETISLFIRPLALGVRLTANLTAGHLLIQLIATAAFVLLPMMPTVAILTSIVLFLLTLLEIAVAMIQAYVFVLLLSLYL

SEQ ID NO: 2560 - protein, 58 aa, Brassica tournefortii
GFAWTMLCMNEIFYFIGALGPLFIVLALTGLELGVAILQAYVFTILICIYLNDAINLH

SEQ ID NO: 2561 - protein, 50 aa, Gallus gallus
LEFLSMINVNLLSISNLPKLNKLRKLELSDNRISGGLEVLAERTPNLTHL

SEQ ID NO: 2562 - protein, 50 aa, Gallus gallus
FLSMINVNLLSISNLPKLNKLRKLELSDNRISGGLEVLAERTPNLTHLNL

SEQ ID NO: 2563 - protein, 50 aa, Gallus gallus
LSMINVNLLSISNLPKLNKLRKLELSDNRISGGLEVLAERTPNLTHLNLS

SEQ ID NO: 2564 - protein, 146 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLD

SEQ ID NO: 2565 - protein, 147 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDG

SEQ ID NO: 2566 - protein, 148 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGF

SEQ ID NO: 2567 - protein, 149 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFD

SEQ ID NO: 2568 - protein, 150 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDA

SEQ ID NO: 2569 - protein, 151 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDAD

SEQ ID NO: 2570 - protein, 152 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADE

SEQ ID NO: 2571 - protein, 153 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQ

SEQ ID NO: 2572 - protein, 154 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQE

SEQ ID NO: 2573 - protein, 161 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQEAPDSDPE

SEQ ID NO: 2574 - protein, 105 aa, Bos Taurus
YLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESR

SEQ ID NO: 2575 - protein, 50 aa, Bos Taurus
LEEAKKKLLKDVEVLSQRLEEKALAYDKLEKTKTRLQQELDDLLVDLDHQ

SEQ ID NO: 2576 - protein, 50 aa, Bos Taurus
GTIENLEEAKKKLLKDVEVLSQRLEEKALAYDKLEKTKTRLQQELDDLLV

SEQ ID NO: 2577 - protein, 70 aa, Bos Taurus
QLQALQAQLTDTKKKVDDDLGTIENLEEAKKKLLKDVEVLSQRLEEKALAYDKLEKTKTRLQQELDDLLV

SEQ ID NO: 2578 - protein, 55 aa, Bos Taurus
KKLLKDVEVLSQRLEEKALAYDKLEKTKTRLQQELDDLLVDLDHQRQIVSNLEKK

SEQ ID NO: 2579 - protein, 65 aa, Bos Taurus
KKLLKDVEVLSQRLEEKALAYDKLEKTKTRLQQELDDLLVDLDHQRQIVSNLEKKQKKFDQLLAE

SEQ ID NO: 2580 - protein, 55 aa, Bos Taurus
GTIENLEEAKKKLLKDVEVLSQRLEEKALAYDKLEKTKTRLQQELDDLLVDLDHQ

SEQ ID NO: 2581 - protein, 50 aa, Bos Taurus
KKLLKDVEVLSQRLEEKALAYDKLEKTKTRLQQELDDLLVDLDHQRQIVS

SEQ ID NO: 2582 - protein, 65 aa, Bos Taurus
DTKKKVDDDLGTIENLEEAKKKLLKDVEVLSQRLEEKALAYDKLEKTKTRLQQELDDLLVDLDHQ

SEQ ID NO: 2583 - protein, 60 aa, Bos Taurus
LEEAKKKLLKDVEVLSQRLEEKALAYDKLEKTKTRLQQELDDLLVDLDHQRQIVSNLEKK

SEQ ID NO: 2584 - protein, 50 aa, Bos Taurus
EKALAYDKLEKTKTRLQQELDDLLVDLDHQRQIVSNLEKKQKKFDQLLAE

SEQ ID NO: 2585 - protein, 60 aa, Bos Taurus
DTKKKVDDDLGTIENLEEAKKKLLKDVEVLSQRLEEKALAYDKLEKTKTRLQQELDDLLV

SEQ ID NO: 2586 - protein, 100 aa, Bos Taurus
RSLEKQLQALQAQLTDTKKKVDDDLGTIENLEEAKKKLLKDVEVLSQRLEEKALAYDKLEKTKTRLQQELDDLLVDLDHQRQIVSNLEKKQKKFDQLLAE

SEQ ID NO: 2587 - protein, 100 aa, Bos Taurus
QLQALQAQLTDTKKKVDDDLGTIENLEEAKKKLLKDVEVLSQRLEEKALAYDKLEKTKTRLQQELDDLLVDLDHQRQIVSNLEKKQKKFDQLLAEEKNIS

SEQ ID NO: 2588 - protein, 100 aa, Bos Taurus
DTKKKVDDDLGTIENLEEAKKKLLKDVEVLSQRLEEKALAYDKLEKTKTRLQQELDDLLVDLDHQRQIVSNLEKKQKKFDQLLAEEKNISARYAEERDRA

SEQ ID NO: 2589 - protein, 112 aa, Bos Taurus
DTKKKVDDDLGTIENLEEAKKKLLKDVEVLSQRLEEKALAYDKLEKTKTRLQQELDDLLVDLDHQRQIVSNLEKKQKKFDQLLAEEKNISARYAEERDRAEAEAREKETKAL

SEQ ID NO: 2590 - protein, 51 aa, Bos Taurus
QNKELKAKLQELEGAVKSKFKATISALEAKIGQLEEQLEQEAKERAAANKL

SEQ ID NO: 2591 - protein, 99 aa, Bos Taurus
ELLNDRFRKTTLQVDTLNTELAAERSAAQKSDNARQQLERQNKELKAKLQELEGAVKSKFKATISALEAKIGQLEEQLEQEAKERAAANKLVRRTEKKL

SEQ ID NO: 2592 - protein, 110 aa, Gallus gallus
ILVLISGGESSDDIREGLLAVKQASIFSFSIGVLNADSAELQQIATDGSFAFTALDIRNLAALRELLLPNIVGVAQRLILLEAPTIVTEVIEVNKKDIVFLIDGSTALGT

SEQ ID NO: 2593 - protein, 105 aa, Gallus gallus
ILVLISGGESSDDIREGLLAVKQASIFSFSIGVLNADSAELQQIATDGSFAFTALDIRNLAALRELLLPNIVGVAQRLILLEAPTIVTEVIEVNKKDIVFLIDGS

SEQ ID NO: 2594 - protein, 118 aa, Gallus gallus
YSTKADVLDAVKALSFRGGKEANTGAALEYVVENLFTQAGGSRIEEAVPQILVLISGGESSDDIREGLLAVKQASIFSFSIGVLNADSAELQQIATDGSFAFTALDIRNLAALRELLL

SEQ ID NO: 2595 - protein, 65 aa, Bos Taurus
ALQEAHQQTLDDLQAEEDKVNTLTKAKTKLEQQVDDLEGSLEQEKKLRMDLERAKRKLEGDLKLA

SEQ ID NO: 2596 - protein, 50 aa, Bos Taurus
EEDKVNTLTKAKTKLEQQVDDLEGSLEQEKKLRMDLERAKRKLEGDLKLA

SEQ ID NO: 2597 - protein, 50 aa, Bos Taurus
LEQEKKLRMDLERAKRKLEGDLKLAQESTMDIENDKQQLDEKLKKKEFEM

SEQ ID NO: 2598 - protein, 50 aa, Bos Taurus
DLEGSLEQEKKLRMDLERAKRKLEGDLKLAQESTMDIENDKQQLDEKLKK

SEQ ID NO: 2599 - protein, 115 aa, Bos Taurus
SELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLA

SEQ ID NO: 2600 - protein, 270 aa, Bos Taurus
SEGDRLRVELAEKANKLQNELDNVSTLLEEAEKKGIKFAKDAAGLESQLQDTQELLQEETRQKLNLSSRIRQLEEERSSLQEQQEEEEEARRSLEKQLQALQAQLTDTKKKVDDDLGTIENLEEAKKKLLKDVEVLSQRLEEKALAYDKLEKTKTRLQQELDDLLVDLDHQRQIVSNLEKKQKKFDQLLAEEKNISARYAEERDRAEAEAREKETKALSLARALEEALEAREEAERQNKQLRADMEDLMSSKDDVGKNVHELEKSKRALE

SEQ ID NO: 2601 - protein, 53 aa, Arabidopsis thaliana
VRDTEFVHQITNVIKLRRAEPLRRSLKPYECKFKTDHLIWVLMKIKCDYRLVL

SEQ ID NO: 2602 - protein, 113 aa, Arabidopsis thaliana
KLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWK

SEQ ID NO: 2603 - protein, 73 aa, Saccharomyces cerevisiae
LVLGALLDTSHKFRNLDKDLCEKCAKCISMIGVLDVTKHEFKRTTYSENEVYDLNDSVQTIKFLIWVINDILV

SEQ ID NO: 2604 - protein, 90 aa, Saccharomyces cerevisiae
LVLGALLDTSHKFRNLDKDLCEKCAKCISMIGVLDVTKHEFKRTTYSENEVYDLNDSVQTIKFLIWVINDILVPAFWQSENPSKQLFVAL

SEQ ID NO: 2605 - protein, 70 aa, Saccharomyces cerevisiae
LVLGALLDTSHKFRNLDKDLCEKCAKCISMIGVLDVTKHEFKRTTYSENEVYDLNDSVQTIKFLIWVIND

SEQ ID NO: 2606 - protein, 75 aa, Saccharomyces cerevisiae
TLVLGALLDTSHKFRNLDKDLCEKCAKCISMIGVLDVTKHEFKRTTYSENEVYDLNDSVQTIKFLIWVINDILVP

SEQ ID NO: 2607 - protein, 76 aa, Saccharomyces cerevisiae
LVLGALLDTSHKFRNLDKDLCEKCAKCISMIGVLDVTKHEFKRTTYSENEVYDLNDSVQTIKFLIWVINDILVPAF

SEQ ID NO: 2608 - protein, 74 aa, Saccharomyces cerevisiae
ITLVLGALLDTSHKFRNLDKDLCEKCAKCISMIGVLDVTKHEFKRTTYSENEVYDLNDSVQTIKFLIWVINDIL

SEQ ID NO: 2609 - protein, 76 aa, Saccharomyces cerevisiae
SDITLVLGALLDTSHKFRNLDKDLCEKCAKCISMIGVLDVTKHEFKRTTYSENEVYDLNDSVQTIKFLIWVINDIL

SEQ ID NO: 2610 - protein, 386 aa, Gallus gallus
MGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 2611 - protein, 178 aa, Bos taurus
MKCLLLALALTCGAQALIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCHI

SEQ ID NO: 2612 - protein, 147 aa, Saccharomyces cerevisiae
MSSNLTEEQIAEFKEAFALFDKDNNGSISSSELATVMRSLGLSPSEAEVNDLMNEIDVDGNHQIEFSEFLALMSRQLKSNDSEQELLEAFKVFDKNGDGLISAAELKHVLTSIGEKLTDAEVDDMLREVSDGSGEINIQQFAALLSK

SEQ ID NO: 2613 - protein, 73 aa, Saccharomyces cerevisiae; identical to SEQ ID NO: 2603

SEQ ID NO: 2614 - protein, 20 aa, Artificial Sequence
  Description of Artificial Sequence: Synthetic peptide
MGSSHHHHHHSSGLVPRGSH

SEQ ID NO: 2615 - protein, 11 aa, Artificial Sequence
  Description of Artificial Sequence: Synthetic peptide
MGSHHHHHHHH

SEQ ID NO: 2616 - protein, 4 aa, Saccharomyces cerevisiae
LALA

SEQ ID NO: 2617 - protein, 4 aa, Saccharomyces cerevisiae
LLLD

SEQ ID NO: 2618 - protein, 4 aa, Saccharomyces cerevisiae
PSEA

SEQ ID NO: 2619 - protein, 4 aa, Saccharomyces cerevisiae
IAEF

SEQ ID NO: 2620 - protein, 4 aa, Saccharomyces cerevisiae
IQQF

SEQ ID NO: 2621 - protein, 4 aa, Saccharomyces cerevisiae
YDKL

SEQ ID NO: 2622 - protein, 4 aa, Saccharomyces cerevisiae
AEFK

SEQ ID NO: 2623 - protein, 5 aa, Saccharomyces cerevisiae
SNLTE

SEQ ID NO: 2624 - protein, 4 aa, Saccharomyces cerevisiae
LKHV

SEQ ID NO: 2625 - protein, 5 aa, Saccharomyces cerevisiae
ELLEA

SEQ ID NO: 2626 - protein, 5 aa, Saccharomyces cerevisiae
SSSEL

SEQ ID NO: 2627 - protein, 5 aa, Saccharomyces cerevisiae
EELAL

SEQ ID NO: 2628 - protein, 4 aa, Saccharomyces cerevisiae
FKVF

SEQ ID NO: 2629 - protein, 5 aa, Saccharomyces cerevisiae
DDLLL

SEQ ID NO: 2630 - protein, 5 aa, Saccharomyces cerevisiae
AELKH

SEQ ID NO: 2631 - protein, 5 aa, Saccharomyces cerevisiae
LAYDK

SEQ ID NO: 2632 - protein, 5 aa, Saccharomyces cerevisiae
LKHVL

SEQ ID NO: 2633 - protein, 5 aa, Saccharomyces cerevisiae
TKTRL

SEQ ID NO: 2634 - protein, 5 aa, Saccharomyces cerevisiae
FKEAF

SEQ ID NO: 2635 - protein, 5 aa, Saccharomyces cerevisiae
DLDHQ

SEQ ID NO: 2636 - protein, 7 aa, Saccharomyces cerevisiae
NGSISSS

SEQ ID NO: 2637 - protein, 6 aa, Saccharomyces cerevisiae
GTLENL

SEQ ID NO: 2638 - protein, 7 aa, Saccharomyces cerevisiae
SLGLSPS

SEQ ID NO: 2639 - protein, 6 aa, Saccharomyces cerevisiae
EKLTDA

SEQ ID NO: 2640 - protein, 6 aa, Saccharomyces cerevisiae
GEKLTD

SEQ ID NO: 2641 - protein, 6 aa, Saccharomyces cerevisiae
AEVDDM

SEQ ID NO: 2642 - protein, 6 aa, Saccharomyces cerevisiae
ELATVM

SEQ ID NO: 2643 - protein, 6 aa, Saccharomyces cerevisiae
LDDLLL

SEQ ID NO: 2644 - protein, 7 aa, Saccharomyces cerevisiae
GSGEINI

SEQ ID NO: 2645 - protein, 6 aa, Saccharomyces cerevisiae
LDLDHQ

SEQ ID NO: 2646 - protein, 7 aa, Saccharomyces cerevisiae
RSLGLSP

SEQ ID NO: 2647 - protein, 6 aa, Saccharomyces cerevisiae
DLKKKL

SEQ ID NO: 2648 - protein, 6 aa, Saccharomyces cerevisiae
ELKHVL

SEQ ID NO: 2649 - protein, 6 aa, Saccharomyces cerevisiae
KTKTRL

SEQ ID NO: 2650 - protein, 7 aa, Saccharomyces cerevisiae
KLTDAEV

SEQ ID NO: 2651 - protein, 6 aa, Saccharomyces cerevisiae
SQRLEE

SEQ ID NO: 2652 - protein, 6 aa, Saccharomyces cerevisiae
FKVFDK

SEQ ID NO: 2653 - protein, 7 aa, Saccharomyces cerevisiae
AEVDDML

SEQ ID NO: 2654 - protein, 7 aa, Saccharomyces cerevisiae
AEVDDML

SEQ ID NO: 2655 - protein, 7 aa, Saccharomyces cerevisiae
QQELDDL

SEQ ID NO: 2656 - protein, 7 aa, Saccharomyces cerevisiae
DAEVDDM

SEQ ID NO: 2657 - protein, 7 aa, Saccharomyces cerevisiae
LEKTKTR

SEQ ID NO: 2658 - protein, 7 aa, Saccharomyces cerevisiae
AELKHVL

SEQ ID NO: 2659 - protein, 7 aa, Saccharomyces cerevisiae
LEKTKTR

SEQ ID NO: 2660 - protein, 8 aa, Saccharomyces cerevisiae
HVLTSIGE

SEQ ID NO: 2661 - protein, 8 aa, Saccharomyces cerevisiae
GTLENLEE

SEQ ID NO: 2662 - protein, 8 aa, Saccharomyces cerevisiae
SIGEKLTD

SEQ ID NO: 2663 - protein, 8 aa, Saccharomyces cerevisiae
QQELDDLL

SEQ ID NO: 2664 - protein, 9 aa, Saccharomyces cerevisiae
RSLGLSPSE

SEQ ID NO: 2665 - protein, 10 aa, Saccharomyces cerevisiae
KLEKTKTRLQ

SEQ ID NO: 2666 - protein, 9 aa, Saccharomyces cerevisiae
VLTSIGEKL

SEQ ID NO: 2667 - protein, 11 aa, Saccharomyces cerevisiae
SRQLKSNDSEQ

SEQ ID NO: 2668 - protein, 9 aa, Saccharomyces cerevisiae
TSIGEKLTD

SEQ ID NO: 2669 - protein, 11 aa, Saccharomyces cerevisiae
EKTKTRLQQEL

SEQ ID NO: 2670 - protein, 9 aa, Saccharomyces cerevisiae
HVLTSIGEK

SEQ ID NO: 2671 - protein, 11 aa, Saccharomyces cerevisiae
YDKLEKTKTRL

SEQ ID NO: 2672 - protein, 9 aa, Saccharomyces cerevisiae
AELKHVLTS

SEQ ID NO: 2673 - protein, 13 aa, Saccharomyces cerevisiae
LAYDKLEKTKTRL

SEQ ID NO: 2674 - protein, 10 aa, Saccharomyces cerevisiae
RSLGLSPSEA

SEQ ID NO: 2675 - protein, 13 aa, Saccharomyces cerevisiae
EELKKKLLKDLEL

SEQ ID NO: 2676 - protein, 10 aa, Saccharomyces cerevisiae
SSNLTEEQIA

SEQ ID NO: 2677 - protein, 14 aa, Saccharomyces cerevisiae
EELKKKLLKDLELL

SEQ ID NO: 2678 - protein, 11 aa, Saccharomyces cerevisiae
RSLGLSPSEAE

SEQ ID NO: 2679 - protein, 16 aa, Saccharomyces cerevisiae
AELKHVLTSIGEKLTD

SEQ ID NO: 2680 - protein, 13 aa, Saccharomyces cerevisiae
KVFDKNGDGLISA

SEQ ID NO: 2681 - protein, 15 aa, Saccharomyces cerevisiae
MGSHHHHHHHHSSNL

SEQ ID NO: 2682 - protein, 14 aa, Saccharomyces cerevisiae
FDKDNNGSISSSEL

SEQ ID NO: 2683 - protein, 16 aa, Saccharomyces cerevisiae
LREVSDGSGEINIQQF

SEQ ID NO: 2684 - protein, 14 aa, Saccharomyces cerevisiae
REVSDGSGEINIQQ

SEQ ID NO: 2685 - protein, 17 aa, Saccharomyces cerevisiae
AAELKHVLTSIGEKLTD

SEQ ID NO: 2686 - protein, 13 aa, Saccharomyces cerevisiae
DVDGNHQIEFSEF

SEQ ID NO: 2687 - protein, 18 aa, Saccharomyces cerevisiae
AELKHVLTSIGEKLTDAE

SEQ ID NO: 2688 - protein, 15 aa, Saccharomyces cerevisiae
LREVSDGSGEINIQQ

SEQ ID NO: 2689 - protein, 16 aa, Saccharomyces cerevisiae
AYDKLEKTKTRLQQEL

SEQ ID NO: 2690 - protein, 15 aa, Saccharomyces cerevisiae
REVSDGSGEINIQQF

SEQ ID NO: 2691 - protein, 19 aa, Saccharomyces cerevisiae
AAELKHVLTSIGEKLTDAE

SEQ ID NO: 2692 - protein, 21 aa, Saccharomyces cerevisiae
LREVSDGSGEINIQQFAALLS

SEQ ID NO: 2693 - protein, 17 aa, Saccharomyces cerevisiae
LENLEELKKKLLKDLEL

SEQ ID NO: 2694 - protein, 17 aa, Saccharomyces cerevisiae
KLEKTKTRLQQELDDLL

SEQ ID NO: 2695 - protein, 18 aa, Saccharomyces cerevisiae
DKLEKTKTRLQQELDDLL

SEQ ID NO: 2696 - protein, 20 aa, Saccharomyces cerevisiae
LAYDKLEKTKTRLQQELDDL

SEQ ID NO: 2697 - protein, 22 aa, Saccharomyces cerevisiae
LALAYDKLEKTKTRLQQELDDL

SEQ ID NO: 2698 - protein, 4 aa, Saccharomyces cerevisiae
INDI

SEQ ID NO: 2699 - protein, 4 aa, Saccharomyces cerevisiae
HLVL

SEQ ID NO: 2700 - protein, 4 aa, Saccharomyces cerevisiae
IGVL

SEQ ID NO: 2701 - protein, 4 aa, Saccharomyces cerevisiae
TIKF

SEQ ID NO: 2702 - protein, 4 aa, Saccharomyces cerevisiae
TIKF

SEQ ID NO: 2703 - protein, 5 aa, Saccharomyces cerevisiae
IGVLD

SEQ ID NO: 2704 - protein, 4 aa, Saccharomyces cerevisiae
TIKF

SEQ ID NO: 2705 - protein, 4 aa, Saccharomyces cerevisiae
RNLD

SEQ ID NO: 2706 - protein, 5 aa, Saccharomyces cerevisiae
EVYDL

SEQ ID NO: 2707 - protein, 6 aa, Saccharomyces cerevisiae
IGVLDV

SEQ ID NO: 2708 - protein, 6 aa, Saccharomyces cerevisiae
LNDSVQ

SEQ ID NO: 2709 - protein, 5 aa, Saccharomyces cerevisiae
QTIKF

SEQ ID NO: 2710 - protein, 6 aa, Saccharomyces cerevisiae
IWVIND

SEQ ID NO: 2711 - protein, 6 aa, Saccharomyces cerevisiae
VQTIKF

SEQ ID NO: 2712 - protein, 7 aa, Saccharomyces cerevisiae
DLNDSVQ

SEQ ID NO: 2713 - protein, 7 aa, Saccharomyces cerevisiae
SVQTIKF

SEQ ID NO: 2714 - protein, 7 aa, Saccharomyces cerevisiae
SVQTIKF

SEQ ID NO: 2715 - protein, 12 aa, Saccharomyces cerevisiae
KCAKCISMIGVL

SEQ ID NO: 2716 - protein, 10 aa, Saccharomyces cerevisiae
HHLVLGALLD

SEQ ID NO: 2717 - protein, 12 aa, Saccharomyces cerevisiae
EKCAKCISMIGV

SEQ ID NO: 2718 - protein, 9 aa, Saccharomyces cerevisiae
HHHHHHLVL

SEQ ID NO: 2719 - protein, 10 aa, Saccharomyces cerevisiae
HEFKRTTYSE

SEQ ID NO: 2720 - protein, 11 aa, Saccharomyces cerevisiae
HHHHHHHHLVL

SEQ ID NO: 2721 - protein, 11 aa, Saccharomyces cerevisiae
SHKFRNLDKDL

SEQ ID NO: 2722 - protein, 12 aa, Saccharomyces cerevisiae
DVTKHEFKRTTY

SEQ ID NO: 2723 - protein, 13 aa, Saccharomyces cerevisiae
ISMIGVLDVTKHE

SEQ ID NO: 2724 - protein, 12 aa, Saccharomyces cerevisiae
SHHHHHHHHLVL

SEQ ID NO: 2725 - protein, 13 aa, Saccharomyces cerevisiae
TKHEFKRTTYSEN

SEQ ID NO: 2726 - protein, 14 aa, Saccharomyces cerevisiae
GSHHHHHHHHLVLG

SEQ ID NO: 2727 - protein, 14 aa, Saccharomyces cerevisiae
MGSHHHHHHHHLVL

SEQ ID NO: 2728 - protein, 14 aa, Saccharomyces cerevisiae
KRTTYSENEVYDLN

The invention claimed is:

1. A method of maintaining or increasing at least one of muscle mass, muscle strength, and muscle functional performance in a subject, the method comprising providing to the subject a sufficient amount of a nutritive composition comprising an isolated nutritive protein fragment comprising a polypeptide sequence that is at least about 80% homologous to a fragment of a naturally-occurring protein sequence over the total length of the isolated nutritive protein fragment, wherein the isolated nutritive protein fragment is at least 25 amino acids in length, wherein the isolated nutritive protein fragment is less than or equal to 150 amino acids in length, wherein the polypeptide sequence comprises a ratio of essential amino acid residues to total amino acid residues of at least 40%, a ratio of branch chain amino acid residues to total amino acid residues of at least 18% and a ratio of Leu residues to total amino acid residues of at least 8%, wherein the isolated nutritive protein fragment has an aqueous solubility at pH 7 of at least 50 g/L, and wherein the isolated nutritive protein fragment is present in the composition in an amount of at least about 1 gram.

2. The method of claim 1, wherein the isolated nutritive protein fragment has a simulated gastric digestion half-life of less than 10 minutes.

3. The method of claim 1, wherein the polypeptide sequence comprises 0, 1, 2, or 3 cysteine residues, or wherein the isolated nutritive protein fragment comprises no disulfide bonds.

4. The method of claim 1, wherein the isolated nutritive protein fragment does not comprise N-linked glycosylation and/or does not comprise O-linked glycosylation.

5. The method of claim 1, wherein the polypeptide sequence has a calculated solvation score of −20 or less.

6. The method of claim 1, wherein the polypeptide sequence comprises an amino acid sequence selected from:
   i. an amino acid sequence selected from a SEQ ID;
   ii. a modified derivative of an amino acid sequence selected from the SEQ ID list; and
   iii. a mutein of an amino acid sequence selected from the SEQ ID list, wherein the SEQ ID list is SEQ ID NOs 4-8, 12-13, 15-18, 20-27, 30, 32-37, 40-42, 45-51, 53, 56-57, 59, 63-69, 71, 74-77, 79, 81, 83, 85, 87, 90, 93-96, 98, 101-102, 106-108, 110-112, 114-115, 117-123, 128-130, 134-137, 139-141, 145-147, 151, 153, 155, 157-159, 161-162, 168-169, 174-175, 177-182, 188-189, 194, 196-197, 199-202, 204-205, 207, 209, 211-212, 214-215, 218-219, 221-222, 225-226, 228, 231-234, 237, 239, 241-247, 249-251, 255, 259-260, 268, 270-271, 274-278, 280, 282-285, 287-288, 290, 292-294, 299, 301, 304-306, 308-310, 313, 315-323, 326-329, 331, 333-338, 341, 348-349, 351, 354, 356, 359-360, 363-369, 372-375, 378-379, 381-386, 388, 393-398, 401, 404-405, 407-408, 410-411, 413-417, 420, 422, 426-429, 431-433, 436, 438-439, 441, 444, 446, 448-449, 451, 453-457, 459, 462-468, 471-473, 477, 479, 481-483, 485-489, 492-493, 495, 497, 499, 501-504, 508, 511, 515-516, 522-523, 527-528, 530, 533-537, 539-541, 543-549, 551-552, 554-557, 559-560, 565-566, 568, 570, 574-576, 578-580, 582-584, 586-591, 594, 597, 603-607, 610-612, 614-615, 617-618, 620-622, 624, 626-629, 634-635, 639, 641, 643, 645, 651-652, 654-655, 657, 659, 663-666, 675, 677-678, 680-681, 684-686, 688-689, 692, 694-696, 701, 706-708, 712-714, 717-718, 721-723, 725, 729-731, 733, 735-736, 738, 740-741, 744, 746-748, 750-751, 753, 755, 757-759, 762-764, 766-767, 775-776, 780-781, 784-785, 787, 800-807, 809, 812-820, 835, 838-839, 844, 847-848, 850-851, 854, 857, 862-863, 866, 868, 871-873, 875-876, 878-880, 882, 884-885, 887, 889, 891-892, 894, 898, 901-910, 912, 915-920, 924-928, 930, 935, 937-938, 941-943, 945-948, 950, 956-960, 964-967, 969-970, 972-973, 975, 977-978, 981-982, 985-988, 990, 992-997, 999-1011, 1014-1021, 1024-1025, 1027-1028, 1030, 1032-1050, 1052-1053, 1055-1077, 1079-1080, 1082-1096, 1098-1106, 1108-1112, 1114-1115, 1117-1121, 1123-1180, 1182-1190, 1192-1205, 1207-1232, 1234-1239, 1241-1244, 1246-1259, 1261-1274, 1276, 1278-1282, 1284-1285, 1287-1324, 1326-1342, 1344-1346, 1348-1360, 1362-1374, 1376-1414, 2519-2532, 2535-2556, 2559-2568, 2574-2596, 2598-2599, 2601-2609, and 2612-2613.

7. The method of claim 1, wherein the polypeptide sequence further comprises a polypeptide tag, optionally wherein the tag comprises a polyhistidine-tag.

8. The method of claim 1, wherein the polypeptide sequence comprises at least one of each essential amino acid.

9. The method of claim 1, wherein the nutritive composition further comprises a protein, a polypeptide, a peptide, a free amino acid, a carbohydrate, a fat, a mineral or mineral source, a vitamin, a supplement, an organism, a pharmaceutical, and/or an excipient, optionally wherein the free amino acid is selected from the group consisting of essential amino acids, non-essential amino acids, branch chain amino acids, non-standard amino acids and modified amino acids.

10. The method of claim 1 further comprising providing a second isolated nutritive protein or fragment thereof comprising a second polypeptide sequence that is at least about 80% homologous to a fragment of a second naturally-occurring protein sequence over the total length of the fragment of the second isolated protein fragment, wherein the second polypeptide sequence comprises a ratio of essential amino acid residues to total amino acid residues of at least 40% and at least one of: a ratio of branch chain amino acid residues to total amino acid residues of at least 18% and a ratio of Leu residues to total amino acid residues of at least 8.

11. A method of treating at least one of cachexia, sarcopenia and frailty in a subject, the method comprising providing to the subject a sufficient amount of a nutritive composition comprising an isolated nutritive protein fragment comprising a polypeptide sequence that is at least about 80% homologous to a fragment of a naturally-occurring protein sequence over the total length of the isolated nutritive protein fragment, wherein the polypeptide sequence is at least 25 amino acids in length, wherein the isolated nutritive protein fragment is less than or equal to 150 amino acids in length, wherein the polypeptide sequence comprises a ratio of essential amino acid residues to total amino acid residues of at least 40% and at least one of: a ratio of branch chain amino acid residues to total amino acid residues of at least 18% and a ratio of Leu residues to total amino acid residues of at least 8%, wherein the isolated nutritive protein fragment has an aqueous solubility at pH 7 of at least 50 g/L, and wherein the isolated nutritive protein fragment is present in the composition in an amount of at least about 1 gram.

12. The method of claim 11, wherein the isolated nutritive protein fragment has a simulated gastric digestion half-life of less than 10 minutes and/or wherein the polypeptide sequence has a calculated solvation score of −20 or less.

13. The method of claim 11, wherein the polypeptide sequence comprises 0, 1, 2, or 3 cysteine residues, or wherein the isolated nutritive protein fragment comprises no disulfide bonds.

14. The method of claim 11, wherein the isolated nutritive protein fragment does not comprise N-linked glycosylation and/or does not comprise 0-linked glycosylation.

15. The method of claim 11, wherein the nutritive composition further comprises a protein, a polypeptide, a peptide, a free amino acid, a carbohydrate, a fat, a mineral or mineral source, a vitamin, a supplement, an organism, a pharmaceutical, and/or an excipient, optionally wherein the free amino acid is selected from the group consisting of essential amino acids, non-essential amino acids, branch chain amino acids, non-standard amino acids and modified amino acids.

16. The method of claim 11, wherein the composition is provided to the subject orally.

17. The method of claim 11, wherein the polypeptide sequence comprises a ratio of essential amino acid residues to total amino acid residues of greater than 49% and at least one of: a ratio of branch chain amino acid residues to total amino acid residues of greater than 24% and a ratio of Leu residues to total amino acid residues of greater than 11%.

18. The method of claim 1, wherein the composition is provided to the subject orally.

19. The method of claim 1, wherein the polypeptide sequence comprises a ratio of essential amino acid residues to total amino acid residues of greater than 49% and at least one of: a ratio of branch chain amino acid residues to total amino acid residues of greater than 24% and a ratio of Leu residues to total amino acid residues of greater than 11%.

20. The method of claim 1, wherein the polypeptide sequence has less than 50% global homology to a known allergen.

* * * * *

UNITED STATES PATENT AND TRADEMARK OFFICE
CERTIFICATE OF CORRECTION

| | |
|---|---|
| PATENT NO. | : 9,598,474 B2 |
| APPLICATION NO. | : 14/374127 |
| DATED | : March 21, 2017 |
| INVENTOR(S) | : David Arthur Berry et al. |

Page 1 of 1

It is certified that error appears in the above-identified patent and that said Letters Patent is hereby corrected as shown below:

In the Claims

In Column 108, Line(s) 41-42, Claim 10, "of at least 8." to read as --of at least 8%.--

Signed and Sealed this
Twelfth Day of September, 2017

Joseph Matal
*Performing the Functions and Duties of the*
*Under Secretary of Commerce for Intellectual Property and*
*Director of the United States Patent and Trademark Office*